United States Patent 10,233,495 (METHODS AND COMPOSITIONS FOR SCREENING AND TREATING DEVELOPMENTAL DISORDERS) - sequence listing, part 148

SEQ ID NO: 784 - DNA, 1078031 bp, Homo sapiens
agttaacagatattgattttctgtcataatgatgttgtgagacaatctaagaggaattaaaatttaaattcatgtattcctcctttttcctctgttctctaactgtaatatattttaattacagatggaggaacagatagatgttagataaataggtatataatatatagatcatccaaaattcttattcttatggttttatgtagtcagtatttacctctatttttctgcatgtttatcattccaatttagttcattacttcctgcacctttgatgtcatatatataaacaggaaataacacatggtggccgggatgtagagagagccacaggacttgtgaataaaatccacaggcaaggatgtggcgattccttttgcaatattggagggaatgccaaaccctatgtttgctgtggaaaagagtatgttagttcctcaaaacatcaaaatggtattgccatatgattcagcagctccacatctcaggatagcaaaagaaatgaaagcagagtcttgaaaaaatatttacacatccatatttgcagcagcattattggcaatagctaaaacgtagaagcaattgaagtgtccaacaacagatgaatggataagcaaaatatgatatatacatacaatggaatattattcagtcttaaacatgagggaaatattctgacatatgttgcaacttggatgaaacttgagaatattatgccaagtgaaataagttagtcagtgaaggacaaatacagtataattccatttgtataaggaacttaaagtggacagagtcacagagatagtacaatgatggttgccagaagctggggggaggaagacatggggaagtattgcttaatgagtatagagtttcagtttcacaagatgaaacgagttatggagatggatggtggggatggctgcacaatgttatgactatatttagtaccactgaactgtgcacttaaaatggttaacagagtacattttatgttatgtgtattttaccacaataaaaaaataaaataccttaggaacattttcctgaaagagtccacataaaattcattttaatgcatgtgtttatgcatagatttctatttttctcttttctatttatattccaaattagaatataatgctaatcaatcatagtggctgtgtttcttccttcctctagtctgcaagtagcaagcaaatgtaataaactacttattcatgtcacacctatttattttctgccttataccaagcttgtgggattctattaaatacaacatttttatacgtacacctatgcaatacccattagcatcgccttcctaaatcaggggaaattgagtgtctgtaaggtgcggtaacttactaagatacaaaactcagcattaaagtctgtatacttcaatatcctgccctcttctcatttgtctttactgccttttatgtatgtgttagatgttcaataaatactcttttttaaactgaatttaagccgtggagcagtgttttgttgaacaataaatatgatattggacactctttctccctttcatttatgatgcagttcatgaaaaagagaaattctttcattgtgctagaagcttaaaataatgaaaatgccactttctacattaaacagaaactgaagggaaacaagatgaattggatgagacatagaaaacaagtgggaaagaaatctagtataatttcccctttgtgcacctttgttatttagcatttgagaaaatgtttcccccaaatatcttcccatcttaattcatgtctataaagtagacatttatgtctcaccttgtcaagaagggcaaactctaacataaacatttcccaaaaatgcttcctgctaaaacgtaagctcagtctggctagaaattaagctcattcataaaaattagttggcagctaatctttgcatgctgttctctgaacttgagtgaaagctgtccatcaggcatacagggaatgacggaaaaggtgacaacagaagatgaatgctatgtcactaaccttcaaagacgaccttccttttctttcaaattcttgatatcttaagacttcattaattcatctttctttgcccttggttcaacattgtgctataccaaaactcatgtaaaacaatgatctattgtaataaaaatggcatttttctttcatgtagatgcaagctatctggcatttttacaatcaacatacttccgttgttaatttttcattctgtattggcagtaattgataggtatttctgaagggatgaaggtgtttctgtgttcattgagatccaaacttttttagacctagtggtgtttgtaaaacaatttgtgccagctgacaaaggaccactgtggcagaaagcagcaaacttgcataagatgtcactgcctcatcagttggctttgaaaactaggggcttactctatagtcctatgaatcaaagacattgattgatgtagtataagattacaatcatattttccttttgacagtcatattataaggcatgatgtattgcaattaatctcaattagctgatcacaattaaaattaataatgtttattattgctgataaacaatcatgactctcctgttctcaaatgtgcaagtaattcttgtaattttaatacaaatttgcatattattactaattgatttaatctcattgtatttggttcatggatccaatttattaaaatattgataatggggcaatgatttgtctccccatttcatttacactaaaagacacaattcgtacaatggtctgcaagcccatcatgatctgccgcatttgttactgagttaaaacaatttttctatattcaagatacatatttatacagacatatagatatgtgtttttcaaatatcttctcacaatttttgagctgccttttgacttgcttggttgtcctttgaaacaccaatgtctttaatttttaagaaatgttaaataactaatttttattttgttgatcatgtttttggtgttacagctatttctttgctagatccaaaatcctgaagattttcccataagctttattctagctcttgcatgtatatctttaattcatttaagttaatatttttgtatgctttggggtaaggattccaatttattattttgcaagtggcgatccacgtgtacgttgttgacagagtttgttcaaagaaggtctcttcctcattgaattgcacatggcaccactgtaagaatccattgactatagatacatagttttatatatggactctcaattctcttccatcaatctatatatttttccttcatcagtattgtgttgtcttgattactgatgctttgccataaggtttggagcatgggggtgtgaattatcctaacatgttttcttttttcaagactattttggctattttaagtcccttacaattccacgtgtattttagaatcagcttgtaagtttctagacagaaatctgttgggatacttgcagggattacgtcaaatctgtagttcaacttgtaaagtactacaatattaaatcttccaattcatggctgtaagatatttgctaattatttagatcttctttaaacaataatttttaattttcagagtaaaatcttatatcacattttccaaattaattattatttctttttttgatgctattgtaaattgaagtgttttcttaatctcattttagggttttcattgtagatgtgtgcaattgatttttgtatatttatcttgtatgctgtaatattgctgaagtaattaactagttctatcgttcagtggattccttaaaattttctatatacaagaatgttatttgcaaataaagttttatttcctcctgttcaatatgggtgactcttatttctttacttgccgatttgccctgcataaaatcttcagtacagtgttgactagaagaggtcaaagtacgtatcctattcttatctctgaccatagcgggaaagtatcctttcttttaccactaagttgaatatttgcttttggcttttcacaggtgccatgtatctggtgtagaaagtactctattcctggctcattgagtttttatttttatttttaatcattaaagcatttggattatgttaaatgtcttttctgaatctatcgagatgatcatgaaattcttgtttcttattctatggataagatgtattaccttaatggattttgggctgttaaatcatcctgagattactagtataaatatcactttgtcatagtgcataattcttttacatgttgctagatctgatttgttagtagtttttaaggaattttgcatttatacttatagtagttttatttttctatgctatttggactaatttttgtatcaaggtaacactggccccacagaataaattgggaagtgaatatttctctttttaaaaaaagttagtcaagaattaatatcaattagtcaatactaacaaatatgatcaatattataaattattaatttctctaatttttattttcttccttctgcttgctttaggtttagtttgctattttttccattgcctttatgtggaaggtcatcttatctcatcctttcctttgtcttttcattttcgaaatagtgtcttttttgcatcaggtgagctccccaggttggtagtactccatgtttattgctgtacaacaatgacaggtaatatgtcctgaagacaatggaaacttaacattcaaaatcctcctagatttcaccttatgtgatatgtcttttcctttgattggtccaatttctaccctttctctattataaaccatgagtacaatggcattcaatgagttctgtgagtctttctagtaaattcttgaaactgagggtgttctggggaaaccctgatctggcagttggtgtcaaaagtgcgaatcgtcttatatggcctcttcctttgaactttgcatctggacccaaactctgcacaatttgggccagcagtctcgtgttgactttgcagcctaaattatcttgtagtttgtctaatcctcaaaaatttgctttcatcaaatattgtatttgttaccccaaaattaccatcatgtatttttctccaaataactaacattaggagaaatagccagctgaatctgtaactcaacagaaacaagtgatccatataccatataagtggccatttcattttgcctccttccaccaaatcttagcaacctcaaccattgccgtgagccactgtaggcctaccatctacaaaccaacaagtatcttttaaaaacacttcatgctcccatttgataaatttcccagcaaagggatgcttactttaactctatgcaagtggctcatactcgcaaagtctgcagatattattcatgtagtgtgagaaaatcatcccagagatgccagcacattctcctacccatgatctgcttagtttgcaaacatattcaggccatgggtgagagatttgtatttcacagtacaacaattttatggaggacattgaaacttagattgagcattttagtacagtcacacatcactgagtgatagggatacgttctaacagatgcatccataggcaatttcatcattttgcaaacgtcagagagaatattacaaacacctagtttgtacagcctaccatgtctggttatatggtagagcctctctctcctaggctacaaacctgtgtactacattactgtactgaatattgcaggcaataagaacacagtggtaagaagttatgtatctaaacatacttaaacatagaaaagtatgtaaaaatgtgtattataatctcatgggaacacttttgtatatgcaatccatctttgactgaaatgttattatgcatgacatgactctatgacaaaaataaaatagtacattttttaaaatgtacaaatgtatcaaacatattataaaactaaaaatatttattcagtgtaagaatttgtaatgatcacaaaatgttcacagcttatatttaagtacagtttcaaatgcctagtgcaattactatttatttctttttgtattttaaacatgtatataataaacatttttcaggttcagcaatatatatcaatcctacaggctcttataaatattagttaaaatcaattggtaaattcatgtgtatatacgcatacctgtatcagtgagcatgtgtgcatgtatgtttgtgtaaacgtaattatatgtgtgtgtaaatgtaattggatgcatccttatatttacccttacctgcaagatttccaagattcatttattatctttagatgatgggcatttaaagatttaccaaatacaacggtaatagtggaaaatatcaagatgttattaaattcatcttgtgcaataattatttctataaatttatgtttcttgtaaaacttgcagtaatgctcatgcacaaaataattttctaaataaaaaataaaaacgttttctcagtcattaattcttaaaattatttctccccaataattaatgtgaattaattcttaattcttaattatagaataatgttgcccttcagagttcggaaacttttacatgttgtacacatttcactaaccagaacaacttctgaaatattggcattaattaatgtcactcagcaattattgatttcaaaggcattaaataccattcatattctgaatcacaagggtactttggcatcttttttaatcaagctctctgtatcatcatctacactttaattacttaacaaacatttctctgtatgagaaagattgagcaggttattgtgcttttttaagatacaacttttgcttaatctagagataggcaatgctccctataagggacaaagagaaaaataaatgagcaatagagatgcgacaggcatggaaaaagacactacatttatcaaacaaataggtcccataaagttttgagtcaattagaatatgtttgtatcagtctgtctacagttttacacctgtcaaaatgtacttgaactacaacaactaccctgaacaattttgaaatgtatgattcctctgaaactgattaaaagaattatggtagagtgaaattctgattgacataatttgggagagaaattattccttggacatcaacctctgccaagatagtttataatgacattgagactttttgatttacaaaatttgttatataaaaaatactaagacgatggcagataatacacagaatttaattaaaattgtactacaattaaatgtctaaataaattagaagggtacatggtacatctaattgtatgtttatatattttatttgtgcatttttttcctagggttgcttttgctttagtttgtaaaacgttcttatttttatgataatgtagcacatactaaataaagaaaaatcaggaaatagaaaatgaagaaaacattagttattgtcaaccaaataaaaattgtgcaatctctaagcacatgaagtatgtattatttgtacagcatgtagaacgtttatgcttcacagcgtgaggtagagactgcaaaaccttgaacttgggacaaataagaaagtaaggaaattttcacaacatattaatattatagaaaatgttgaacttaacagttaaggtacaagtagtgaaaaatgatagtatttaaggagatctagaaaatttaatctatacctgtaatgtgtgagaagtattagaataatgcttgtatttctggatttgcatcaatttctattgagactggaaacataatagaagtgagggaaaaagaatttaaattgtggatacttgagttttatacctaggagttcgagaaatacattttgttactatcaaagcagttggcacaagagtgtacaaaattccctaattgtgtctatgtggagaagacatagacaaacagagaatagtaaaacagaaatagcaaaaaagcacaaacaaattttacctgtaattttaagtaaaagccaattagagaaggaaaacatgaaatttgtgttttatcaaaatttttctctttctcataatgcagttgaatatattactggaaaaaaattgaagcactggtatgttcacaaaaaaagtaaaatataaggtcaaaaccatgggaatgcagggagcagacaaaatataactaaacaccgaaactgattttgccttatggacgtgtaccaaaatgaatgagtgcagattcctactgtcatacatcacataagacagtaaagaaatacatagtttttcccaagatagagcatcacacaggagctcctccctaaagctaggaccaaaatttatatcctgagtataaagaagaatcagaggtaaattagtcccatttcacattccctggaaatggcaaataaaaatgacttgagattggacagatttaaagaaactcaatcactaatgatttagagcaagtaatttaaaaattgtttaaatgtgcaacccaaacatacgtccaaatccctttaggccaagaattaacataatgtggtcccagaatggtggtgcctttagtagaatcacaaaaaaattcaaattctctttggcaaattttctacttacaaatcctcaaaagtgcacaaaaataattttcagagaaaaataaatatttgtcattcaaaggcatctaagtatgcaaggaaatgatattccaccatttgaaaggaaagcagaaaaggagtacaaacagatccacaaaggttccttagtagatctatcacttagattataaagcacatttgctttcaaaaatttttttaaaaaagaatatattgttaggagactaaaaaattgatgtagcaaatttgaaaagaagtttgtataaaaatatagttattttaaattaaaaactcaaaaatgaactcatcagattagacatgactatggtgagagttcataaatatttcagaatgcattacagaaaatttaaaaaaaaggaaaatgtggacagaatgatgaagagacatggaagatacagtgagaaagtgtagcatgtgtttagtgagtgttctcatagaagaagggaactgggaagggacaatatgtgatgatattttgggtgaaagttctctagacttttgtaagacactaatctgcatattcaaaaattctatgcatgctaagcaagctataatggagataaacctacacctatgtatctcctagagaaatagtaaacaaccaggaagggaaaaatatttcaattagcactagaaaaatgaaattacttttagttatattgaaatctgaaaaaatgaaaggtaaaataaacaatattatttgctaagaataataatgccattctgaaattctcaacgaagaaaaatattcatcaacctatggctaaataacatatttagagacagaaaacaaaatgccaccagcagaattccactaaagaaactaaagagaatctctgaaaatattcttcagaaatgttgaagttctgaaatcaaagagtgaacacagagcaaaatatattgtaaacatacagatagatctaaataaaaaattaggtgttgaaacaaaaatatatttaaaattagataatcactgcaatatgtatgttaggaagaaaattattagggctggagtattcaaagaacccttaactgtctgacaagaacagaaaagtgagtatgactttgcaactctttttctttttcgaatggaatggaatggaattgaatctaatggaattgaatggagtggagtggaatggaatggactgggagctgagattgtgccattgcgctacaggctgggtgacagagtgagacactctcaaaagaaaggaatggaatggaaagcagtggaatagaatggaatggaatggaatggaatggaatggaatggaatggaatggagtggagtggagaggagtggaacggagtggaatggaatcggatgtaatggaatatagtggaatggaatggaatggaatcatcatcaaatggactcaaatggaattatcatcgaaaggaatcatcatcgaatggaatcgaatggagtcatcctcgaatggaatcgaaaggaatcatcatcaaatggacttgaatggaatcatcatcgaatggactcgaatggaatcatcattgaatggaattgaatggaataattgaatggaatcgaatggaatcatcattgaatggaatcgaatggaatcatcctcaaatggaatcgaatggaatcatcaatgaatgcacttgaatggagtcattatcaaatgtactcaaatgaaatcatcatcgaatggaatcgaatggaatcatcatcaaatggaatcatcatcgaatggaatcgaatggaatcatcattgaatggaatcaaatggaatcatcaaatggaatcgaatggaatcatcgaatggaattgaatggaatcatcatcgaatgaaatcaaatggaatcatcatcgaatggaatagaatgcaatcatcaaacggaatcaaatggaatcatcatcgaatggaattgaatggaatcatccaatggaatcaaatggaataatcatcgaatggaatcattgaatggaatcaaatggaatcatcaaatggaatcgaatggaatcatcatccaatggaattgaatggaatcatggaagggaatcgaatggaatcatcattacatggaatcgaatggaatcatcatcacaaggaatcgaatggaatcatcattaaatgatatcgaaaggaaacatcgaacggaatcgaatggaataaatcaaatggaatcgaatggaatcatcattgaatggaatcgaatggaatcatccaatggaatcaaatggaataatcatcgaatggaatggaatggaatcatcatcgaatggaatcaaaaggaatcatcaaaaggaattgaatggaataatcattgaatggaatcgaatgaaatcctagaatggaatcgaatggaatcatcgaatggaatcaaatggaatcatcaatgaatggaatcgaatggaatcatggaatggaatctaatggaatcattatcacatggaatcaaatggaatcatcgaatggaattgaatggaataatcatcgaatggaatcgaatggagtcatggaatggaatagaatggaatcatcatcgaatggaatcgaatggaattatcgaatggaattgaatggaatcatcattgaatggaatcgaatggaatcatcatcgaatggaatcaaatggaatcattgaaaggaatcgaatggaataatcatcgaatggaatccaatgaaatcctcgaatggaagggaatgcaatcatcgagtggaatcgaatggaatcatcatcgaatggaatcgagtggaatcatagaatggaatcgaatggaatcatcatcgaatggaatcgaatggaatcatcgaatggaattgaatggaacaattatcgaatggaatcgaatgcagtcatccaatggaatcgaatggaataatcattgaatggaaacatcaaatggaatcgagtggaatcatcaaatggaatcgaatggtgtcatcatcgaatggaatcgaatggaatcatggaatggaatcaaatggaaacatcatggcatggaagcaaatggaatcatcaaatgcaatcgaatggaatagacatcgaatggaatcatctaatggaatcgaatggaatcatcaaatggaatcgaatggtgtcatcatcgaatggaatcatctgatggaatcgaatggaatcatcatcacatggaatcgaatggaatcatcatcaaatggaatcgatgggaatcatcaaatggatcaatggaatcatcaaaaggaatcaaaaggaatcatcttcgaatggaatcgaatggaatcatcactgaatggaatcattatcaaattgatttgaatggaatcatcattgaatggaatcgaatggaatcatcgaatggaatcaaatggaatcatcatagaatggaatcaaatggaatcaacgaatggaattgaatggaatcatcatcaaatggattcgaatggaatcacccaatggaatcgaatggaataatcatcgaatggcatcattgaatggaatcatatggaatcatcgaatggaatggaatggtgtcatcatcgaatgtaatcatccaatggaatcgaatggaatcattgaatggaatcgaatggaatcattgaatggaatcgaatggaatcatcgaaaggaatcgaatggaataatcattcaatggaatcaaaaggaatcctcgaatgcaatcaaatggaatcatcaaatggaatcaaatggaatcatcatcaaatggaatcatggaatggaatcgaatggaaacatcatcacatggaagcaaatggaatcatcaaatgcaatcgaatggaataaacatcaaatggaatcatcgaatggaattgaatggaatcatcgaatggaatcgaatggtgtcatcattgaatggaatcatccaatggaatcgaatggaatcgaatggaataatagaatggaattgaatgggatcattgaatggaatcgaatggaatcatcatcaaatggaatcaaatggagtcatccaatggaatcgaatgaaatcatgatcgaatggaatagaatggaatcatcagatggaaacaaatggaatcatcatcaaatggaatcaaatggaatcatcgaatggaattgaacggaatcatcatcgaatggaatcaaatggaatcatgaatgaatggaatcattatctaattgaatcgaatggaatcatcatcaaatggaatcaaatggaatcattgaatagaatcaaatggaatcatcaaaaggaatcaaatggaatcataatcgaatggaatcaaatggaatcaacgaatggaattgaatggaatcatcatcgaatggatatgaatggtatcatccaatggaatcgaatttaataatcatcaaatggaatcatcgaatggaattctatggaatcatcgaacagaatcgaatggtgtcatcatcaaatggaatcatccaatggaatcgaatggaatcatcgaatggaataattgaatggaatcgaatggaatcattgaatggaatcatcatggaatggaatcaaatggagttgtccaatggaatcgaattgagtcatcatcacatggaatcaaatggaatcatcgaatggaattgaatggaatcatcatcgcatagaatcgaaaggaatcatcatcacatggaatcgaatggaatcatcattgaatggtatcaaaaggaatcatcgaatggaatcaaatggaatcgaatggaatcatatttgaatggaatcgaatggaatcatcatcgaatgaaatcaaaaagaatcatcaaatggaatcgaatgcaatcatcatcgaatggaatcgaatggaatcatcatcgagtggaattgaatggaaacttcaaaaggaatcgaatggaataatcatcaaatggaatcaaatgaaatcctagaatggaattgaaaggaatcatggaatggaatcgaatggaattatcatcaaatggaatcaaatggaatcatggaatggaatcaaatggcataataatcacatggaataaaatggaatcatcgaatggaatcgaatggaatcatcatcgaatggaattgaatggaatcataatagtatggaattgaatggaataatcattgaatggaatcgaatggaatcctcgaatttaattgaatggattcatcgaatgaaatcgaatggaatcatcatcgtatggaattgaaatgaatcatggaatgcaatcaaatggaatcatcattgaatggaattgaatggaatcatcaaatggaattgagtagaatcatcatcgcatggaatcgaatggaataatcaaatggaatcaaatggaatcatcatcacatggaatcgaatggaatcatcattgaatggtattgaaacaaatcatcaaatggaatctaatggaataaattgaatggaaccgaacagaatcatcatcaaatggaatcaaatggaatcattgaatggaatcacgatagaatgaaatcgaaaaaaatcattgaaaggaatctaatggaatcatcatcgaatggaatcgaatggaatcatcatcgaatggaatcgaatggaatcatcaaaaggaattgaatggaaaaaacatcaaatggaatcaaatgaaatcctcgaatggaatcgaatggaatcatcgaatggaatcgagtggaatcatcattgaatggaatcaaatggaatcattgaatggaatcaaatggaatcctcatcgtgtggaatcaaatggaaacatcaaatggaatcgaatggaatcatcatcaaatggaagtgaatggaatcatagaacataatcgaactcaatcatcaaatggaatcaaatggaaaaatcatcgaatggaatcgaacagaatcattgaatggatttgaatgcaatcatcatcaaatggaatcgaaaggaatcatcaacgaatggaatctaatgcaatcatcatcaaatggaatcgaaaggaatcatcaacgaatgaattgaatggaatcgtcaaaatgaatcgaatggaataaacatcgattggaaacaaatggaatcctcgaatggaatcaaatggaaacatcgaatggaaatgaatggaatcatctttgaatggaatcgaaaggaatcatggaatggaatagaatggaaacatcatcacatggaagcaaatggaatcatcgaatgggattgaatggaataatcatcaaatggaatcactgaatggaatagaatggaatcttcgaatggaatcgaatggtgtcatcatcgaatggaatcatcccatgcaatcgaatggaatcatagaatggaatcataaaatggaatcaaatggaatcaacaaatggaatcgaatggaatcatcatcgaatggaatcgaatggagacatccaatggtatcaaatggaatcatcattgaatggaatcgaatggaatcatcaaatggaattgaatggaatcatcatcgaacggaattgaatggaatcattgaatggaatcgaatggaatcatcatcgaattgaatcaaatggaatcatcatagaatggaatcttcttccaatagaatcaaatggaatcatcgttgaatggaatcgaatggaatcatcgaatggaatcaaatgtaatcatcgaatgaactcgaatggaatcatcaccgaatgaaattgaatggaataatcaactggaattgaatggaatcatccaatggaatcgaatagaataatcatcgaatgggatcatcgaatggaatcaaatggaatcatcgaatggaatcgaatggtgtcatcatcaaaaggaataatccaatggaatcaaatggaatcatcgaatagaatcgaatggaatcatcatcgaatggaatcgaatggaatcatggaattgaatcgaatggaatcatcatttcatggaatcgaatggaatcatcatcacgtggaatcgaatggaatcatcatcgaatggtattgaaaggaaacatcgaatggaattgaatggaacaaatcgaattgaatcaaatggaaccatcatcgaatgaaatcaaatagagtcatcgaatggaatcatcatcgaatgaaatcgaaaagaatcatcgaatggaatcgaacgcaatcatcatcgaatggaatcgaatggaatcatcattgaatgtaattgaatggaatcattgaaaggaattgaatggaataatcattgaatggaattgaatgaaatcagaatggaattgaatggaatcatcgaatggaatcaaatggaatcatcatcgaatggaatcgaatggaatcatggaatggaatcaaatggaatcatcatcgcatggcatcaaatggaatcatcacatggaatcgaacggaataatcatcgaatggaatcgaattgaatcatcaaatggaatcgaatgcaatcatcgaatggaatcgtcatcgaatggaatcgaatgcaatcatcatcaaatggaatcgaatggaatcgaatggagtcgaatggaatcatcatcaaatggaatcgagtggaatcatcgaatggattcgagtgtctgttcagacaggtctgggggatatctaaaggactcatgaaaggctgtttttttctgtgttgctagaataaagaacatataaggaatggacatttttaagaaactctgcaaggagacctaacaaaccacggatgcttagggcaaaaattagagtttacacatatagtagatcaccttcagcacaggaagaaaagttggagaagagtatttggaaaactaagacattcaaaatcattcacgtacatgggagagtctagaaagtcacatgtatgcataggttaagccatatgctgaaaaatgacataagaagaccctacacttttaccttggccgatccctcccctcagtgcaagctctgtgcaagagtgaacttgaacttcactcagtgcaagagtgaacgcacactttgtggcggctttaaagaacccagcacaaagctagtctgcatggcctagagacatattttgctggataatgattacttgtttttctttgtttttgttgtatttgcctgttttcttagttcctgacatacaagaaaatcactgtcaaaacattagcttaacatttgttaaggaaacaaaaagcctttggtgaccacaccttataaagcaaacagttttgtaaatcactttggaaaatttcactaaaaaaaatccttaacaatataataagaaaagaaaatttaaaaccacaaaacattactgtgtttgtagggggggttctgatttacagagtaaccacatagtaattgtaattattataatgtccagttttcaaaaaaagttacaaggcatacaaagaatgggaaagtatggctcattcaaagaaaaaaaacaaattgacagagaatatctctaaggaaacccagacatcaaacttactagacaaagactttaaaacaactctcttcattatactcaaatgtcaaaaggaaaacataaacaaagaaatcaaggaatcagaacaaatattaaaaagtaggaatatcaacagagataacaaattctggagcggaaaactacaacgataaaaatttaaaaatcaccagagggatttaagagtatatttgcacacacagaagaagacatgagcttgaagataagaaaatggaaaatattgactctcagaaacagataaaaaatgagcagagactaatgaatctgtgggacatcatcaaatagatcaacattcatattctaaaaggataaattatgttgttgaaaactttagcattctttcttttcacctttctttcttcctccctccccctcctcctcctttttacttttcttcctcttcctttctcttcttctgtctctccttcattatcccttttgctctgtttctctttctccctttctcttttctttcaattatctcaattacgaagagatgtttaaatacccttaccatgtgagttgatatggttatttctgcctttagttcttttttgagatttatagtcactctaagtaaagagataacccaaacataagcctcataaacaggcttccataccattcttaatttggtcctgtaattcttcattgctgtgttaactttctgatgcttttaaggatgttttataacaaattgtttagttttttccaatggagtgtttattctgaattatctaattcatattgtaagtatagagggagtttaatataaaattattaagctgacatttgtgaaagaatgtatttgtgcatttaacaaatatgttaatcctcagactgttattgggcagctgagcatacagcaataaaaataacataatttttatgtgtgcaatatttatggaatacgttactggaccaaataaataatttagttaataacatgacaaagaacagaaattgtatacactataaagcatagtaatggaataatgaatgattaaagttattaatattaggtagaaaataaagggtatctttgagagcagaaatcaaggaagcaagcaattcgccttacgaggaaagagttacctgtggataaaggagaaactgaaaaatttacaagtcaagactttttgagcaaaaacaaaaatatgattattagtcaccaattcagtacagtgaaaaaaaagttgaagagatatcttggaagtaaaccatgttgtggaagagcatgtagggttttgataatcatgggattattctgaattaattttaaatgcaataggaatatatgagataatttcagcagagaataacatgattgtgtttgcatttcaaaggggtgtatctggtgcaccgtgtagaataaataggttatgtgagcaaataaattaggaggctattgtaatccagagaaaaaaggcagtgacttaggtgagaatgctgtcaggatgagtggtattagtggtgagaagtcgttaggccatggatgtatttcataggactggccaagagaactgcagctaaattggagtgtagggaatgaaatggagaactcaaagatgactctgagcactggaaagtgacagctgtcactgaagcatgctgatgcctcttattaagagagttacttgggaatggcaagatcaagacttctcactttcaaatttatgaaaaatattgttttcagaacgaatgactttgggatcagaaagccaccattctaattgatggttccacgactacacgggctcacactcccaagaacaaaagtaaataatcacaaaggtgcttcctgataatctagagaatggagaattactgtaacatctttctgattttaggagaggtagcagttccctgtttagcctaaacgctattttttttaaagctcagcaaagagactccaatataattttcaaacgtgtgtaacttaaattctcatatgaaataccactatgcttaaattagtcaaaacattttccctatctacaactctatcttgtcactgcaatcattttcacaaaagtgactgcagctcacagacactaaaaggagaaaatccagggtaggttacctgatctagttagtttcgaagacaggatctagagattatttaatatgaaataggtcacctgaaatgtttactgaaaacagcttgggtcagcccagttttctaccactgaaccatgcatttggtttaaaaaacacaacaactctggggaatatcagctgcttccaactgtgttgaaggtgttaaagaaaaaagcataaaataaaaaatgatcatctgaggcctttatagtctctgctcaagacactagagtcttccattcttaatgaaacacccaaatatcttaataattgggcaaaatctaagtatcagagagataattttatcttgaagattgttaaattataatggtgattcactaccttgccacgtctctgagtcaaaaattaggtatttgtttaggaatcaatcataatctgcaatttggaaataggaagattttagaagactcagacattgactttcttgtgtgcaaaaaaaagacgtattgagataagacaagtctttccttgcaaggatacctctaatgctcatacaccacctcccctaacattaatagagcttccaggtcagtaaccagtgtcagagagcagcccatgcaactacaaattcaatagatgtcgaacacagggtcaagcctagaataagaagtcttagctaattaagtatgcttttttccccaaactcatattaacaaaaacttggatatgtcagagaatgcattctaagttcactcaacataggagggagaaacataattttaaattaagagctgaagcattcttgtcctaacagaaagcaaggaaaacgaaatatcacaccacaggagggatttcacaaattagtgtcaacatcaaaaccttaaaataggcaaggagaatggagattcacagtgaactcttgtacttgttttattcagagaagagatggttctgagagaatgacagtgaactaaccccagctggtttagttggtgctttcaactgctgcttctgatcaacttctttagctagaaaaaattgatgaggattttggcatgtggtattagagatggttattaactttttcctcttatttgcattgttcaatgtagtaaatactagctgtgtgtggctacttcaattcaaattaattacaatgaaatatacttaaatattgaattttttagtcactgttggttcattattgaatatcttcagctaagatttcccatctaaatacactaagaggtggcttagttaactggttgtccacaaatattgaagctgttgttaactcctgatatattctctgcaaagagaatattcatgagcctcctcctgaaatcagcagcctagagacagttttataaattggatacaagttggaaatctatatactctttaagtttttgaaatattagcttcccagggaagaaaatcaaattcataagatatgttaggacaatttaactcaagatgttcaaaactgaaatgacatattctacaatatgtgataaaaccaccccctaacaacttaaagcaaaacagggattgaccttaaagacctgccttttcctcatcccccagccaatcagttttcaaatcttgcattttattttgaaaggttcttatccccctggtctcttgtttctagatttggcacatatttttgttacctctatctactgacttttctctcttcaaacagtatctatgcctgccaaatgtgaacatacaaaaaacaaatcagaatgtgccattctgatttaaactgcttattagttaataccctcaaggcaacatctgggttcttggctgcaatgagtcaagcctacttacatctttttttgtctttggctgcacatttcctatcacatcacactccagcaatgccaagctgtgccggccttctaccccatctccactattttgccctccgccgccgcggctttttgccccccccccccgcccctccccggctttttactctccgagacttttcgccccccgtcgccgcggcattttgccacccgccaccgtggctttttgctgcccgccgccgcggctttttccccaccgcggctttttaccgcccgtcgccgcggctttttgcccacccgccgccgcggctttttgcccccaccgctcctcggcgttttgcccgccgcggctttttgcgtccccgccgccgtggctttttaccacccccccccacgtgccgcggttatttacccgccggagctttttgcacccccgccaccacgactttttgaacccccgccgccgcggcattttgccccccgccgcagcgactttttgcccgccacggctttttgcacccccactgccgcggctttttgccccccgacgttgcggctttttgccgcccgccgccgcggctttttgccccccgccgccgcggctttttgccggtcgcggcttgttgcccccctgccaccgcggctttttgcccccaccccccggtgccgcggttatttgcctgccgcggctttttgcccccgactgccgcggctttttgcccgccacggctttttgcccctcgctgccacggctttttgcccccccgctgccgcgattttttgccccccgcggctttttgcacccccgccgccaaggctttttgccccccgacgtcgcggctttttgccgcccaccgctgcaccggctttttgcccgccgcggctttttgacccccccgccgccgcggctttttccccactgcggttttttgccccccgccgccgcggcattttgccccccgccgccgcggctttttgccccccgccgccacggctttttgcccccccgccgtcgcggctttttgacccctgccgcagcggctttttgtcccaaggccatcctcagaagcatgagtggaacagagtgaagggaaagctattttcttctaaagctcaaaaatcttgaactttcaaataggaataagtgttatttttgctccaagcacacatttgagaaatcttccatttagcggatctgatgataaacccacattttttgtttgttttaatctgaaaatgtatttgtatggttcttggaaattttttttgcatataaaattatattttatcagcttatttcaagttttatttaccattttataattactcctaaaatgtcattgattaaagaaagaatcatctattgctccaactgttctttactaaaggtaattttctttttaacctcatcaggctccttttaagctctcaaactgaccttattttttttttacagattcaatgcattaagtcaatttatttgactgaatttatttatgtatttattttcgctatcacaagtagaaaaagcctgtaagttgctatgccaaaatcctgcctctagatggcaaacaaaccccacaatacacaaaagagagccaaattcttagaaaccctgggaaaggaagagggctactgtcccattaacaacttggagcccttaaggcaagaatgaggtggaacatctggaacatctgggaggagacagcagggtgcagagtagtggggaacctgctctgtgctctgagactgaaagcccagccttgcctctcaccgctgccttgactgtgtccccatctgctgtgaagtgaatggtgtcttctaaattcatgctgagccctaattgctgaaaagtgtaagacatgcaatggggggattatgtgcatcttcctgacaccaacatgatgctgaggaaggagacttcttgttttctcttaggattcttttactaaccaagattttgcctctactgcgtatttccctttgctgattgtccctcccttttgacagaagatggcccagggcattcactactaagtctcaacctcttacccaaagtcgtcagtctagggttgctctttccttcatgctatttttgtgtgtttcttttcttgtaatcatcttggcaataaaataatcacttttttctttctacctattaaagatgttaccttagttaattacagtggtttccttcagaatgataaatagtctttcaaaatgatgtaaagagatctaaatccgtgtgctccagaagttgaaagaagctctgtctagcacgggtgccagtgactctcccagagtgctccatgcagctggccccacagagtccctctgtgctgtcatatcacccactgccttctgtgaatgagatattctgattggaatcctggtggatgctatttgagccagtgcccccacaactcctatgaaagccgaggaccacaggcccctgaagacaatcacaggtctctagactcacagctcatgaccgtcctctgcagacacaacttctccccggatggctgagggttgtcattgtctgtgtccttccttgtgcatgacaacaggagacatagaaggtctgtaagcagccctgcaagccagtttctgagcaagccctcctgtgtggggccctcttacctggacataggtgcgtaaaccaaaaatgaaactctaagctccctaaccaactgaatgaactcctcctctcagccaaggacacaccaaaatcaacttgaaatacaatgcagtccatgatcggaatggatgattggatatgccttaacttaccctcttccctttaaaattcaggcacaactgaccagcttttaatatgaagacagagaccttgagactgacaaagaaaactctttataccaataagataccaatgtgacagataccacgtcctaagagaaatcaaagtattttccccaagatattgttatttaatgtatttaaaaatgcctctgcaaagctggttcttgtgggaaaaatctacattctgtagagattcctttttaagtctctttcctgacccagagagatttaactaagagtttggcaccttttaagtctactaagaaacaattacaatctattctctctgaagcctgctacctggaggcttcatctgcatgatgcaatcttggctccaaaaccctttttctaaacccagaaactcccttgtgttgattacaggtcattaaataaactatttcaaccacctatgaaatctttgaatccaactatgacctggaagtccccaacatcccccctcctttgggctgtcctgtctttccatatcaaagcaatgtacagcttacacgtattgattgatatcttatgtctcccgaaaacgtgtaaaatcaacctgtagcccaacgacctttgacacactttctcaagacctcctgaggctgtttcactgatatttctttaactttgacaaaataaatttctaaactgattgagacttttctcagatacttatttgtttataggtatcactggatacacttaaggaattgaagagatttatgacattgagaaaactaggaagccagggtgtgtggagagagagagagagagagagagagagagagagagagagattgtgatgtatgtacaggactaacactgagacctggttatgtaatggtgtagtactgagtatcatccccaaatagtgaggtttcattccaagaagactacgcatgtatctcatttgggaaaacagcttttgcaggtgtaaattaaggagcttgaaacagggagatggtcttagattaatcaactgggacttaaatgcaaactcaagtgtcctaaaaaaaacaagaggtagagacacatttagcatagactgaagtggagaaggcaatgtgaacacagagacagagattgcagtgatgtgtccacatcccgggagagagaagccaccagaagctggaagagctaaatcagactgctccctagagcttcagaaggagccagaactgatgactccaagatcttagcccagtgaaactgatctggacttctgaactatgagagattccattcctgttgtttgaagctaccacatttttgagaacttgttacagtagcccaaggacactaacaaaaatggggctccgggaaaatccagactaaaggtgttgtgttggtttgcaatctccttgcttaactttctgatactagacataaatagatcagtgaaaaattttgtgattgaagcaatgtacatgaaacctacagtgtacagagaagcatctgttagttataagataaatatcgataattttagttgaaaatgacatatgactgttaatatctcacataacattctgagttactccagaatgcataaaaggggcactagatactcttctcatgtatgtgtgtgtgtctgtctatacatgtatgtacacttcatggtgcatcagctggcggaaccctcaggacaccccttcacatccccagtgctccatttcacacatgaggaaactgttcatgacagcacatggctgatttgcataaaagtcacttggtcagcagttgttgaagctgaacttggaatctaggtctgtctgaccttaactatgttccttccacagagccacgttcattccatagaggaacccaccacctataaaaccagaaaagagacaaagccagaagtgcaggttggatttcttaacacaagctcactgcgacctctagtcctcatcacgctgacactaagcttaaacccagacccttctacagttttgtctacaaagcacaatttgcccaaagcctttacaaacaccaacagcctttctttcagatatggcagcagggtcacatcttacacggccctgatcacattttctctcctctgccatccccatctctctgactcagtcctcgcttgcagccataaaaatggatgagttcatgtcctttgtaggggcatggatgaagctggaaaccatcattctcagcaaactatcgcaaggacaaaaaaaccaatcactgcatgttctcactcacaggtgggaattgaacaatgagaacatatggacacaggaaggggaacatcacacaccagggcctgtcgtggggtggggggaggggggagggatagcattaggaggtataccttatgtaaatgacgagttaatgggtgcagcacaccaacatggcacatgtatacatatgtaacaaacctgcacgttgtgcacatgtaccctagaacttaaagaacaataataataataaaaaaaagaatgagtcttgtacatctaatttgcctcacaaatgttaaaacagcaaacccgcatccccttcctcttctcatgtgctgtgagggatgacctccaggctctcagatactaagattgtacaagacctaacccagagaattactcaagacactctacataagaagaattgtggtgctagctctcctcatagaaaaatattttctgtctcttgttgagattgacagcaaacacaaaaacacggaactatttgggagaacagaagacagtgatacactagggaagtaaaacacaccccttccccttgcattggtttcctgttgctgctgtaacaaattaccacaaccttactgctccacataacacaagtgtattatcttacatttctggaggtcagaagtctcaatgaagtaaaatcaaggagtaatagggctctattcagtctaggcttcaagagagagaatccaatattgagcattccgtctttctgatgttcccacattcctagcagcctggcccgttcctccaccactccagtttccctgtccattgtcccaggtcctctctggctgttaccttcctccctccctattgtaaggacccttgtgattatgatggtctcacccagataattcaggatactctcctgaccccaaaattctcaaccatgtctgccgagttatttttgacatattcataagtaacgatcatagattccagatattaggacaatgatgtctttagtgggtgtattattcattccacaaacaactctcatcatccacacaatggtcttcccctaaggtagaataaaaatatcacaaggcagatttatgaggcgatcgacctagaaaaaacctgagactctaggactgtctgatgtgtggatgtcaaatcctgggagattctgagtctctgctctatgtggactctatgttgtgtagccatttgtggaaggcttctgtgattttgtgacctagagaaaatgaatctctgctaaaatcaaatctaagaaagattggcaaagggaatttaaatatttcctaaatttttggaatttccctaggcattaaaacatgagaagtggcaataattcaaaccaacgatgccctccaagaataaggatttttccaatgcattaggttgggtcccctcagtgagaaggatgccaaagattcgcatgtagacagtatatttacaaagtgcgggaaacaagcaagtgagcaagggaggggaggagggaaagggaaagtgaaaggtgcctcagaaggagccacctctgaggatgacgagagctcaagcccacatagaaacacaggaaaaatgcctctgttattccacctgagaggtgagggagctgggggatgtgtacacctcccttgtcatcactgattgacagccgtcctaggggatgctaattccaggccatgaggtctgcctcatttgcagcctgagctgcttccccaggttcagatagagcagtgaaggggagaaagggccatagagagtcagctgaagtataatgactagaatccccaaggcgtagtaacaatgactgctaaaattatgcacaaagaaaaagcgcatttgaatccagagatgtatctctctgaatctggatatatggatcctggcagcctgttcagtagccatttcccagaaatccagtcctctggaaaagcagcaggaggtttgtgcacaggctgcactaccttggtctggccactggtagtcgtgcatgagaactactccctggagtatttctcagtccactgacactgatgtaattggctccacttcccctgctgttgagccaggccaacatgccctggacaaaggcatctgtgtgaagtattgaggttcaaatcagtgcttaagatatgtttggatgcaaaatactttttcatctacatgggcagtgtcttggcagaagatggagattctctctaaatggatgtgagacagggtggctggcatctgggtcagtatgatgccctggtgcatggcaagaacatgcattgggcagcagctgccctcactaaggagagaggttcactgacctggcttttcacccctcacctgctctccagaaagccagactctagggcagatgctcctgagactccaagaacagtctggtggggagcgcagctgagagcattactcaggggatgtggcttttgtcatcctactttgaaacaattgactatctgagcctagattgatagagggcttcaagttgattttaatccaggctcctatagtcagcgagtgaaacagagattttagttgaaataatgacacctggtattactagtcagctctccatgctggagaaccataagaaattataccaaaggcaggaaaggggatagatagaatatggggatcatcacgccaagaataaggtgcagcccatttagcccctgggtcttaaagagacccatagctctggataatggcagatctatgcctgacacagttatcatctttgtgcatcttcagagaattgtttttccttttactcctaggaacaatgtcttaagtttgttagtaaattctatttaatttattaaagatgctgctgataaattctttttatattcatttcaaaaaagaagcaatttcacaccgacagagacattgttattatagcactaaatacttttacactcatcaaattcctttgagactaactgaaatttctgacagccctacattctactactttattgtaaattttctgccaaaaaggatgctttcctatacactcctaatacaagtataaatatattatttaatctagtcttaggttgatttaaaattttgaaaattcactccaaaaatatgttctgtaaccatatggccaccaatgagaaatgtattctttcaaggtaaatctgtgctgtcctggtctgacctgggactctggggatactgcgcccgtgtgctgagttactgagatgagccagccctgcagctgtgctcagcctgccccatcccctgctgatttgcctgttcctagagcacagccccctgccctgaagaatttttataggctgttcacacccggtgcaggagtcagccccagtcaggacacagcacagaagtgagggcccccactcagctcctggggctcctggtgctctggctgccaggtaaggaaggagaacactaggattatactcggtcagtgtgctcagtactgtctggaacttcagggaagtcctctgataacatgattaattgcaagaatatttgtttttatgtttccaacttcaggtgccagatgtgacatccagatgacccagtctccatcctccctgtctgcatctgtaggagacagagtcaccatcacttgccgggcgagtcagggcattagcaataatttaaattggtatcagcagaaaccagggaaaactcctaagctcctgatctatgctgcatccagtctgcaaagtgggattccctctcggttcagtgacagtggatctgggacagattacactctcaccatcagcagcctgcagcctgaagattttgcaacttattactgtcaacagagtgacagtacctctcccacagtgttacaagtcataacataaaccccaaggaagcagatgtgtgaggctgggctgccccaatgctctttctggtgcctctatctgctgagggaagttctcaaactcagtcaggtttggaaagtcattgggagattttcctagaggaggtcaggaggttcctctgaaccctaagcctctttcgccctcatccccagcagaaaagacgtgacaatgcctgtcctgactgaataaagaagagagataagtccagctgaggagtctgtgttatgggataatcggaatttgtacagcaaaagagaagctattctcagtatttcaaggagaaattattcaagttgaataaattagagtctaaaccacagtctttccgaagcctgtggagtgttattcatgaagtaggtactagacacaggggattctcaggtgctacttcagaagccatggtgcacctgcacctggtggtatgtgctgaacactgtgtgatgatcctcggtcctgtctgggaagcccagggctgggggtgctgatgctctcagctgcctgcagcacatctccaggtgattctccagtccacacctaactgcatgtgttttacttcaggtgtcagtgtacatgaatccaccactctgacttcccaatctcatgacagtaattagttgtaacttattgtgacctcatggagcaactctgaagaaaccatagagagaaaaggagttttggaaaatgtgctcccagaagtgatagtaatgatggggaattgacagctgacggggaagtaaggtgactctttccacaaggctcaacattttgccagttatgaattgttgcaaaatacatttgaatgtgctttcaagtactatcagtttggggtcatagctgaaaaacttatattaagtcacagataaaatgggaaaatcaggaaattgtatgaaatatacaataacactgtgtgtgatggctcaggtctgtaatcctgtgatagttaatactgattgtcaacttgattacattgaaggatgtaagcattgctcctgggtgtgtctgtgagggtgttgtccaaggagattaatatttgagtcagtagtctggggaaggcagaccccctacttaatctatgggcaccatttaaccagctgccagtgaatataaagcaggcagaaaaaagtgaaaaagtgagtctggcccagcctccaagcctacatctctctcccgtcctggatgcttcctacccttgaacatcggactccaagttctttagttttgagactcgagctggctttccttactcctcactcctcatgcctgcagacagcctgctgtgggaccttgtgatcctgtaagttaatatgtaataaacccatatatatatattgaacttattagttttgtccctctagagaaccctcactaatacagatttcggtaccaggatggttctgcaggaacagaatattaaggttggagttcttttgttggttttggggtttctggatttggctgctaaatatgattagatcccaaaatgctaaggactctacttttaatagtgtagagaacattgacagttcttggcatgaaaggtttaaacagctatgcaaaacaaattcatttgacactaatgaatcatcgctcttgagaggcaaggagtttagtgactctgtacctaatacccttgacaaacaccttgcaaaatagatttgtgaggacagcacctgcatctttgaagagccctgtaaaggctcttctctgtatgtcagatctaatggtgagaactgcagtcactcagttacaaaagttaaatacaatttggaataattggatcctgaagtggcaggggccaagtgttagcactcaaccctcaaaggcacggtgagcgtagctacggtaatgggcagaaaagacaaagcagcaatctgaacagtctgactcatgtagagctctggcattggctaactaatcacagttttcctagaagtgaaactgacaggaagactaatgcattcctacttaatttatgtaaggaggaaacttaaggtcaaacagataaaagactaattggagttataaaaacagagattcatggcccctcaatcaatttccagccttgagccagtttacagacccagaaccccttgaatgaaggggaggctgagtccccctgaggtgtccgtggcagataggaatgctgctttgaggctttggcaggcatccttaggtgaatcatggtggaggcccctagtattttgcagcaaggcccggtcatcttctccagttaactactctccttttgagagacagctcttgtcctatactgggcttttgtggaaactgaacatttgactatgagtcaacaagtcaccatgcgacctgaactgcctattgtgaactgggtgctttctgactcatgtagccataaagtgggtcatgtacagcagcattccatcatcaaatggaaatggtgtataagtgattgggctcaagcaggtcctggggggcacaagtaagttacatgaggaagtggctcaaatgcgcatggtctctactcctgccaccctgccttctctcccacggccagcactgatgacctcatggggacttgcctttgagcagttgacacaggaagggaggactagggcctggttcacagatggttctccacaataggcaggtaccacccaaaagtggacggctgaagcactacagcccctttctaggacatccctgaaggacagtggtgaaggacaatcttcccagtgggcagaacattgagcagtgcacctgattgtgcactttgcatggaaggagatatttccagatgtgcggttatatactgattcatgggctgtagccaatggtttggctggatggtcagggacttggaagaagcatgattggaaaattggtgacaaagaaacttggagaaagagtatgtagagggacctctctgagtggtcaaaaactgaagatatttgtaccctgtgtgagtgttgaccaacaagtgacttcagcagaggaggattttgataatcaagtggataagatgacccgttctgtggataccactcagcctctttcctcagacacccctgtcattgtccaatgagcccatgaacatagtggccatggtgtcagggatggaggctatgcatggattcagcattgtggacatccactcaccaaggctgaactctctgtggccactgctgagtgcccaatttgccagcagcagcagagactaacagtgaaccctttgtatggcatcattcactcgggtgatcgaccagctagccggtggcaggttgattatattggacctcttccaccatggaaaggagagaggtttgtcctcattggaacaggcacttactccggatatgggtttgcctacctgcatgcaatgcttctgccaagactaccatttatggactcaaggaatgccttatccactatcacggtattccacacagcattacctctgaccaagcactcactttacaggtaaagaagtgaggcagtgggctcatgctcacggaattcactggtcttaccatattccccatcttcctgaagcagctggattgatagaatggtgggacggccttttgaggtcgcgattacaacgtcaactaggttacaatactttgccgggccggggcaccatactccagaagaccatgtgtgctctgaatcagcgcccaatgtatggtattgtttctcccatagccaggattcacagatccaggattcaaggggtggatgtgaaagtggaaccactcactatgatgcactagcaaaatgtttgctttctgttcccacgacattaggttctgctttactagtcatcttagctccagagggaagagcgctgctaccaggagacacaataacgattccattaaactggaagttaagatggccacttggacgctttggggtcctcctacctttaagtcaacaagctaagaatggagttacagtgttggcggcagtgattgacccagactatcaagatgaagtcagtccgccactccacaacggaagtgaggaagagtatgcatggaatataggagatccattagggcgtctcgtggtattatcaggcactctgattaaggtaaatgggaaactacacccaatccaggtaggactacaaatggtccagatcctctccgggtcacgacctgctgaggtgcttgctgaaggcaaagggaatacagaatgaatagtggaagaaagtagttatcaataccagctacgactacctgaccagctgcagaaatgaggactggaactatcatgagtatttccttcttcttttgttaaaaacatatttgtgcatgtatgcacttgtactaagaaaatatcttcatttcatttcccttttctttatcaggtgacatcgatttgctgacctcatatcagcatttaagtattgtttactgtatgtaatagtatttgggttggggattggtgcatttccagttgtaggaaggatagtttattatgttggggtaattatgatcttactattgtctgtaatttaagactatgtatgatctcaggagatgtgtgtgggttcaagttcacaaggggtgggcttgtgatggttaataatgagtgtcaacttgattggattgaaggatgtaaagtattcatcctgggtgtgtctgtgagggtgttgccaaaaaaaagattaacatgtgagtcagtgggctgggaaaggcagacccacccttaatctgtgtgggcacaatccaatcagctgccaacccagccatactataagcaggcagaaaaatgtgaaaagagacaggcctcgcctcccagcctacatctttctcccatgctggatgcttcttgccctcgaacatggactccaagttcttcagttttggaaccctggctggctctttttgctcctcatccagcagatggcctattgtgagacttggtgactgtgtgagttaatacttaataaacttcctgtattagccagtgacatctagagggacagaactaacaggagatatatatatatatatatagatagatagatagatatagatatatatatagatatatatatagatatatatatagatatatatatatagatatatatatatagatatatatatatagatatatatatatatacatacacacatacatacatatatatatgcacacacacacacatatatatatatttatttataaaggggagtttattaacttataggatcataagttacacaatgggttgtctgcaaactgatgagaaaggagagccatggagtccaatgtttgagggcaggaagaaaccagcatgggagaaagatgtaggctgggaggctaggccagtctctccttttcaaatttttctgcctgctttatatttgctggcagcagattagattttgcccaccagattaagggtgggtctgccttccccagcccactgactcaaatgttaatctctttcggcaacactctcacagacacaccctgggtcaatacttcatatccctcaatcctatcaagttgacactcattattaaccatctcactccccttcatatatatatatgtatatagtcctttaattctgtcactctagagaaccctgactaatacatctacacttctgatggtctatttcttttattttaggtcatttatttcccctgggttgcctacactcgcttcttcccactcccctatgaaggacaatataagcctctggacctcactaagtcagggcatgtccctgcttgcactatgcatgacacttacctcttttactctttagcaatgagggaatgtcatccttacccagatgccagccacccgtctcacatccaggacagagagtctccatctcctctccagcaaatacccatgtatgtgggcatggtggcatgtccctgtgatcccagctactccataggcttagtggggagaatcacttgtgcttgagaattcaagattgcaatgagccatgatcacaccactgcacttcatgctgggtaactgagtgagaccctgtgatttttcccctacattttacagatttttttttactctttcttctattaatttatgttttgtccattcattttctgcaaacctttagagggcaaataggaagtttccctttttaacgtggtggctcacgcctgtaatcccagcactttgggaggccgaggtgagcagatcacctgaggttgggagtttgagactagcctggccaacatagagaaaccccacctccactaaaaaaaatacaaaattagcagggtgtggtggtgtgcacctgttatcccagctactcaggaggctgaggcaagagaattgcttggacctgggaggcggaggttgcagtgagcccaaattgtgccactacactccagcctgggtgacaagagcgaaactccgtctcaaaaaaacaaaacgaaacaaaaacaaacaaacaaaaaaaccctactgcctcactgaattaaagccgtgttcagcagtttctttgttatttcaaagagtggcatctgcttcagcagggtcagtttttaatgtatttgttttgtttcttttttctctggtgttcttttttattttattataattttttaaatttgagggatgaggttttcatagtactgaatatcaaacaatgaatccgcatgaatgattcacctaatttccttggttttagtcctctatacaggttttatatagcaaaagaaccatttaaagacttgggttacaaatgtattttattttacctctggcatgccttggcctgagaaagcattatatggtggcacaatatttgtaacattctcatcgccatctggtggtggttcgaggtatgacgttttgaaaatctagcaagaattaaaatatgtcaagttagaaagaaaaattccagattattattaagatataattcattttgccccaagtatatacttcagactaagcatcctggaactaggttctataattaaatagataaattacactgacaacaatgagaaagagccttatcattattattgtcttcctaataatagaaacttttataaatgcatgcaatcccaggtaaccaaaagtttccttataaagtgtaacagcggagcctcaaaggtggcactttggcaagcctctttttttgactatggcttttcagcttcctttgtgggctccttttctttcatctttatttaaataatatttccttatgttttatccccagcccgttgcttgcctctgtactgcctccctgcgagacttcattaagtatcagaattttacccatagctcatatgcttatgatgcttaccttttcagattcgtatatttaaatgttttgtggttatttcattctggatgtcctaactcaacatgtctcaccccgggcctgcttttggtctgcatttcctacctctattaatagcttcagtcattagccacggacaccagacagtctcggagtcatcctgaactctgtcttcccctccttccccaagtcaatcactaatcaagtcctgctaatacattaccttactatttctgaaatccatccctcttcctcattcctactaacatcctaatttaaaactttattatcttttacctggactattgtcttaagacaacaactttaatccgttgcttagcctaggtgtaatccacagaggatcttgtctgtctaaaatgcccctctagccacatccttcgcctgctcagatcttgtcattggctcccatgaactgaagttgaagtttaagctccttaggacagcatacacgcgcttctatgatctgttcccagaacatatttactggtttatttcatatcatggcccactttgtattttacacttttgaaatacagacaatcattacattctcccaatagtactaagctagtgtatgcctaaaagcctttgccaatattttatcttttgttgagaattctcttagcttattttgtcacgtggttaactccttatgtcctttcatgactcacaagtcaagacttcaggaaaccttctctaactcccaggctgggctgagtgacccttttctgggtaaataatgaactctaatcatactcttcatagcacttaccatactaatttgaagtctgaagtattccattgtctgcctcactttacttaggcaaaggaaccatgtcctagtctcattctggcctcaggagttcagcctgggtgacagtgggagactgtgtgtcaaaaaaaaaaaaaattgccaatgattgaagcctaatactgaagattctggtttattaataattagtctgttgctgggtgttaattgagctccccaagtgattactcatgtaggacttcaaaccaataatttagaaccttgtgactcaaaatctgggcaaaaataagcagcatcagtatcacctgggagcagcttccggtctcattttagatttactctgaatctaaatattatatttttattaaaaaaaaacaagaacagatgacaagcttcaactacatctaaattctttagatttactttaaaagaatcaacattttgacacaataccaaagtgaactaaattcgctttttttttttttttgagacatagtcttgctctgttgcccaggctggagcgcagtggtgcaatctcggctcactgcaacttccacctctccagttgaagcgattatcttgcctcggcctccaaagtagctgggattacaggcacatgccatcattcccggctaatttttgtatttttagtagagacagggtttcacaatgttgggtcagctggtctcgaactcctgacttcaagtgatctgcccacctcggccttccaaagtgctgagattatagacatgggccacgatgcccagcctaaatttgctttaatttggagtactggtctagaaaacacaaattccaaggagactcaggttcttaagttgatttcttgagtacaagttcttcaaatgcattctccaagattaatttttttttgtactttttaaattgacaaagattatacatattcatggctatacggggatgtttcagtacatgtagatggtgatcagatcagggtaattagcatatctatcatctcaaacatttattatttctttgtgttgggaacattcaaactactcctaggtattttaaactacataatatagtatcgttaactatagtcatctacagtactgtagaacactagaacttattactcctacctagctgtaattttgtatccattaacaaatctcttactattcctcctttctcgctacccttttcagcctgcagtatcctctgttctactttttacttctatgagatcaacttttttttagcttctgcgtgagtgagaacatgtggtgttgaaatttctattcctggcttattttgcttaacataatatcctccagttccatccatgttgctgagaatgacaggattttatttattcttttttatggctaaatagcattccttggtgtacatataccacattttaaaaatccattcatctgttgttggaaacctaggttgattccatatcttggctattgtgaacactgttgcaataaacatggggatgcagatgtctctgcaatataatgcttttctttcctttggataaatacccagtagtgggattgcttgaggggtttcaatactgttctccatactggctgcactaatttacattcctaccaacagtgcataagagttcctttttctccagctactcaggaggctgagggaggagaactatttgaaccctagaagcagagggagccagattacaccatcactgcactccagcctggacagagagtgagactctgtcaaaaaaaaaagtcccttttcttcacgtctttgtcagcatttgttatttttgtctcttctataatagccatcctaactggagtaagatgatgcctcactgtggctttgattagcatttccttgctgattagtggtgttgaacattttttcatatatttgttggtcatttgtatgtcttcttttgagaaatgtctgtcagagcatttgtttatatttaattagattgttgtgcttctttgctgttgatatgtttgaattccttgtatattcttgatattaatttcctgccggatgagtagtttatattttctcccattctgtaggttgtgttttcactcactttattatttcctttgctgtgcagaagatttttagcttgatgtgatcccatttatttattttttcttttgttgcctgtgcttttgatgccttattcataaaatattttcccagagcagtgtcctgaaggatctcccttatgttttattctagtagctttaccattttgggtcttatatttgggtatttgagatactttgagttgatttttgtatagggtgagaggcaggggtctagtttcattcttctgcatatggatacccagtttttccagcaccatttattgaagagactatcctttccccaatgagtgttcttggcatctttgtaaaaaatccgttggctgagatatgtggattttctgggttctttattctattccataggtctatgtgtctgtttttatgccaataccatgatgttttgggttactacagttttgtagtatattctgaggtctggtagcatgatacatccagctttgttctttttgcttaggatggctttggctattcaggatattttttgattccataaaatctctttggatttttttaattttgtgaagaatgttcataggtattttgatagagattgcattgaatctgtaggttgcttttgagtagtactgtcactttaacaacgttcatatttctgatccatgagtatgaatgtcttttcatttgtttgcatcctctttaatttctttcattagtgatttgtagttttcattttacctccttggttacatttatgtctgggattttttttggtaactattgtaaatgggtttgccttcttaatttctttttcagcgagtttgttgttcatatatataaatgcaaccaatctttgtgtattagttttgtgtcttgcacaaataatttctttatcttctagttctggaaataccaggtgctgtgtatgtaaagcaggaattttggttgaatattgtataattttctgaccccctgttactaatccagtttcccctgtactctgatcttccatgctacagacagactgacagatgctcagcaaatagtagctaatattttctaggaaactaggtgctaaacgagttttcttaaatttctacctccaggtctgtaagttgatttgaagcattaccagtttctggttctgcacaggttgttgagcgcaggacttctctcttccagtggaaagtccacctgctcacaaacaaccatcctttcctgcggccttcagacactgctcagtgtagcacccctcccagtctagaataagcacactcatcatcagtctctctcattttctgtcttatctccattccttctacacacagtttttgtttttgccaatgtttttaaataaacaactgtacaagcacaacaatgacaacagaaaccctccttcctcccagtgttgtagtgagcaaggaatatatttaacttcaaataaaagacaaaaacaaatgctggataaagctgacggaaagaaatgaaactgtaggtgctctggcaatatagaaatgatacaactaagaaaaatggaagaaaaggaaagagagagtattcctcagaatgattttactgactgctcactgtaatgcctgggagtcaacggatattgtttatagaaatgtaagcatacttaatggcaccaggggaaacaaagttaatatgattaaatcaaattgtgggatgaaaaatcacataaggaggacaagaaagagaatacagctaataccattgttcttagtttagagacattagctactgtctaaagaaagagatgattttatgaaattacataaggtagccatcagaataaaagtttaactcttccaaatatcacaacatcaaaacaaaagcaataaaaacaaacaagacagcaaaagacagatatgtacatataaatcatagcataatatactgtaatcaaaatataaccaaacacaatttatcattaaaagtaagtgggcttgactcttattagaggaaaaaatattgtcagattaaatcaaaaagcaaatctcaattctatgctggatataagataaagtgttacagaaagtttagaaataaaagtaaaggcaatgaataaaaggatcttctcttcatgcgttaggagtataaaacagtaagtaaacacatcatacagtttctgtttttacacttaaatggctggagatgttacaccactagtatgaatttacttcagatatataaaggatacacttttatgtggttagaaacagcaatgataatagttaaggtgaaaataacatctgcattgacgctaggaagaaagagccattgttgggtacatagtgatcacattaccatggagcaatctgttcccaactgaaatgcccttgcccttctattgaaatcatgtaagattctgcaaaagtagtgtttacttcccacaaatcagccatttgtgggaatggctgctattgttgtccacacggaatcagcatcagacctatatttagctgttgtaccattaagagtcatatttggccctttccagaggctgttatttcaattatattttggagaattagtctatttgcagacaaataattttaccagaactttgatccatatgaaatgaccctttggtagggatccagggattgagtttatttttaattactatagcatcctggtcaggttgagaaacagattacctttatatttccctggcatgtgagcagggctagatttagcgtgagaatgcttgaaagtttatagttttttagaaattttatttactgtgtgtctctttatcaaaataaaattaattctgaaaagctctattaaatgaattattttgagatggtcttttccccttcatccaatgagaggatatccacagatatgtcaggagcttgctttacgtagaaatgtgttgagggccacaggtttgggttcacctgggaatgtttagggacacctccccaagttgttgttgaagagtggggtaaatgtaagatagaattaggctcacggagaccagatgagagcatcatgtcaccccagaaacacagcatatacctaagagatctgttctcagtatcaaagtcttaagcaccgtaagattgcatatagaccaagacaacaactatatatatatatatatatatatatatatatatatatatatatatatatagttaataaaatcagttaatatataaacatatacttattaacttatttttatttttatcttcagacagcatcttgctctgtcgcctaggctggagtgcagtagtgcaattaaggctcactgcagccttgacctctggggctgaaactatcctcctgcctcagtctcctaatgtgctaggatgagaggtgtgagtcaccttgccaggcccagggcaataactatgcaatgtttatataatttggagcaaaaaaaatatttgaaatatgtgtgcattgctttttaaccttttctattgatttactttattaaatactgaatagaaacaatatatttataaaatatttattttatatatataataagcacataatgaacacctgtgtctccagtcttggtttaagaaattaagccaaaagtaatcataaatgcttatgattacttttgaagtcatctgtacaacttttgctgactacatccccttcttcaaaactctaatgatggccactgtgagcactgtgtatattgaattgtgttgtattttaataccgtgtgcactacattgttttcctagctggatgctattgcatttagtgagcataatgaattatatcaatataattcacttttgtcatttcattgtttcagcttttctgtactaattattgccaatatatttctactggcataaaaacagacacataggacagtggaacagaatagagatcgcagacaaatctacatatttacaaacaactcatctctgacaaaggcatcaagaacatacacggggaaaacaacagtcttttcaataaatgatcctgggaaaactgaataactatatgcagaaggataaaattaaacccatctcaccatacacaaaaatcaaatcaaataaaaatggattaaagacttgaatctgagacctgaaactatgaagctaattaaaaaaaaaagcataggaaaggctgggcgtggtggctcacgtctgtaatctcagcactttgggaggccaaggcaggcggatcacaaggtcaggagatcgagaccaccctggctaacacggtgaaactccgtctctactaaaaatacaaaaaaaaaaaaaatatagtggggcatgatggtgggtgcctgtagtcccaggtactcgggaggctgaggcaggagaatggcgtgaaaaaaaaaaaaaagaaagaaaaaaagaaagcgtaggagaaatgctccaagacattagtctgggcaaagatttttttgcgtaagacctcggaagcacaggcaacaaaagcaaaaataggcaatgggattatatcaaactaaaaagcctcaagcaaaggaaacaataaagtgaagcgccaaccacagaatgggacaaaatattttcaaactatctatctgataaaggattaacaagtagaatatataaggagctcaaacaactcaataataaacaaacaaaaaatctgattgaaaaatgggctactgaagaggctgaggtaggaggatttcttttttttttttttttttttttttttgagatggagtctcactgtcgcccaggctggagtgcagtggcgcgatctcggctcactgcaggctctgctcccccggggttcatgccattctcctgcctcagcctcctgagtagctgggactacaggcgcccggcaccaagcccggctgattttttgtatttttagtagagacggggtttcaccgtgttagccaggatggtctcgacctcctgacctcgtgatccgccctcctcagcctcccaaagtgctgggaatacaggcgtgagccaccgcgcccggtcaggaggatttcttaatcccaggagtttgaggttacagtgagctatgattatggtactgccctttagcttgggtgacaaagcaagaccttgcttctaaaaaaataatagttaaaaatatataaataaatacaatttaaaaatgggcaaaagatctgaacagatattttctcaaaagaagacatacaaatggccaataggaagatgaaaaaatattcaatatcactaatcatcaaagaaatgcaaatcaaaatcacaatgcaatatcatctcaccttggttgaaatgacttgtttcaaaaagacaggcaataacagatgctggcaaggatgtggagaaagggaaatactagtacactgttggtgggaatctacattaataaagccactatggagaacagtatggaggttccccaaaaaagtaaaaatagaactaccacgtggtccagcaatttctttactggatatatatccaaaataaaggaaattaatatatcaaagacatatctacatgccgatgtgtactgcagcactattcacaatagacaaaatatggaatcaacgtacaacaaatgaatagattttaaaagtcatatatatacataatggaatactactcagatacaaagaagaatgaaattctgtcattcgcagcaacataggtggcactggccatttggcttaacgtaatgaacataggccattgtgttaagtggaatgagccaagcacagaaaggcaaataccacatgttgtcactcatatgtgggcagtaaaaaagtggatctcatgaagatagaaagtaaatcggtggttgctagaggccagcaaggggagtgggaagaggagattaagagaagaaaatataaatgtatttatcaccactaaactgtcctctaaaaatgtacagatggtaaattatatatatattttttaactcaataaaaaattaaaaaaattctgctgtgtgtttatagggcacatgtacaagactttctctagggttgtatcagttttctgttcctgctgtaacaatttaccacaaattcagtggcttaaaataacacatttttgtgagatttgagtcagttttaaaaaacacacacaaacttattgtcttagaattgttttggttggaaatctggcatggctctcactgaactaatatcaagatgttggcaggctgcatttctttctaaaggctctaaaagagcatctgggttgttggcagaattccgttccttgtggttgtagatcctcagtttcttcctggttgtaaactttgggtcattcccagcttctaaaggtcactggctttccttggcttgtggccccctaccactgttttaaaagccagtaatagcaggccacatctttctcatactgccatctgtctgaatctcagcatccagaaaatattctctgctctcaaggaattatgagattagattggctcaccaaggtaattcaaggtaacttccccatttcaatgaccttaatggtaatcacatctgccaagtccctttgaacatgctaacttacgttagcatgttcaccttatctgaagactgggatgtggctgtctttggtggggggcaattattctgcctaacccaaagatacacaacttgcagatatacaactggttcatggagatgaaacattttcaaatctacaagaaaatgttttctaaaatgagcatttcatattagactttcacaagcactgtatcagaattatatttacttcataatgttgccaatactgatatcagatatttaattttctagccagttcaggataatgtgaattgtgaataatatatttgttcattcagtcaacaaacattttttatcagataccaccgatatgctggacagtgtcatggatcctaaaaatatagctgttatttttttttttaaacaaagtccccactgtgataaagcttttattctttgggacaggcagacagtaatccagataaataaatgcaagggcaaattgggggaaaaattggaatggagagctcagaatctggccccagagaagggcggagggaaaggggacccagttcagaatctcggtgcgtccacaccaaacaattccatgagggctgaggagacagagctgaaaggcttgtctgacatcacaagagacagaaaagtgagccccattttcatctctatcctggcaatgttcctggcttgatttcctccttccagcagacacaagaatcagggagcgcaccctgatggtaagatttttttcagaggcctattttgggcatcctggtgagaacctgagtccgtcactgaccacggcagcccagcatggtccccagtgcgtggcccaaggccaagattctctacctccatcctggaggcagaagaaatgtctgggggaaaatgagaggttttaggtggttggcactgggtgagaccaaggagaaattttaaagctgtgtgtcctggggccaggggcggtggctcacgcctgtaatcccagcactttgagaggccgaggcgggcagatcacgaggtcaggagattgagaccatcctggctaacggtgaaaccccgtctctactaaaaatacaaaaaattagccgggattggtggccggcgcctgtagtcccagctattcgggagactgaggcaggagaatggcgtgaaccgggaggcgcagcttgcagtgagctaagatcgcgccactgcactccagcctgggtgacagaaagagactccttctcaaaaaaataaaaataaaataaaaataaaaaatagaaaaagctgtgtgtcctttgtttcttcatattttgcagatttttgatgtcaaaatattttcatagtcaaaagagtgttaataaagaatgacttctctgttataaaaaccctaatagtgaatgtatttaccaagaagttagattctatctttggtttttttgttttttgccccgtagtttaaaaaaaatagttttattgtatggatattctatagttagtgtatctattcacctcttgatggacatttggtttgcttccagttgtttttactatttcaaataaagttgctacgaatgtttgtccaatcgtttggacatacgctttcatttgtcttgggcaaataagcaggatttgaatgactaggtggtgtgatatgttcaatttttttttttttttttttttgagacggagtctcgctctgtcgcccaggcccaggctggagtgcagtggtgcatcgcggctcactgaaatctccgcctcccgggtccacgtcattctcctgcctcagcctccggagtagctgggattacaggcgctcgccaccacgcccggctaattttttgtatttttattagatacggggtttcaccgtgttagctaggatggtctcgatttcccgacctcgtcatccgccagccttggcctcccaaagtgctgggattacaggtgtgagccaccactcccggccagtttaacttttaaagaaactgacaaagtggctgtatttccagcagcggtgtatgagcattcctgtttctttgtgttctcaccaatgtttagtatggtcagtcttttaaattttagctattctaataggcatgtggcagtatctcattgtagttttaatttacatttccctaatgatgaatgatgttgaacatctttcaatgtgcttacgtatcatccatctgtattctatggtgaaatgtctgttcagatctctacatttgtgttagactatttgttttcctattattgagtcctgagagttctttgtatattttggataacaaatgtatcttcaccagatatagcttttgtaaatttttactcccagtctgtgatttgtctttttattctctcgatagcgtttttctttctttctttttttttttttttttttttttttgacagagtctggctctgtcacccaggctggattgcagtggcacgatctcggctcactgcaatctccgcctcccgggttcacgccattctcctgcctcagcctctcctagtggctgggactacaggcgcccgccactacacccggctaattttttgtatttttggtagagaggggtttcatcgtggtctagatcacctgacctcgtgatccacccacctcagcctcccaaagtgctgggattacaagcgttagccaccgtgtttggccactggatagtgtttttcacaggtcagattaatttttatataaatcatttattttatttttattatgtaaaattttataatttttaattttatttttaatttcctttttaaaaggtaaataaaattttaagtgtaatgatgcaaaattttgtttaaaagtaaatgcatataaaaatgttgatatagactaaaaaattgaataagaaggtagttagttgtcacagtaggagtgaagtgaaaagcttcccctttcaccctctgaagattaaccgaaatgaactgaccatacacagattaataaaagaaagggtatacaaacttacttaaactgcaaaaacatgagagctatacacaaagtataagacttgaagatggctcagatcttaaacgctctcctcataggcaatagatatatagacccaggatgcagacattattttgtaaataatttcctttggaagctggatgggacagaataattacgggacggtgagagatggaactgcacaggaaaaagtttgtctttgtcactttaatcttatcattactagagaataattatgaatattttagaataatatatttttaagcccaaacctcaccaaatgttttttctaaaacaaatactttttgttgttgtttgtttgtttttgatactgtgtctcactctgtcacccaggtatggagtgcagtggtgcaaccatggctcactgcagccttggcctcctgggctcacgtgattctcctacctcagccttccaagtagctgggctacaggcatgcaccatcatgccctggtaattaaagaaaaaaataatttttgttagagaccaagtctcattatgtcaccctggctagtcttgaactcctggaatcaactgatcctcatgccttggcttcccaaattattgggattataggtgtgagccacagtgcctgaccacatatttctatacttcactgaagaaaggaaggtgctaggaaaattggttaagaactattttttaaaaagctattagtagtgttttattttattttattttttaatgattgattgatttttgagattgggatctcactatgttgcccaggctggtttcacattcccaagtttaagcaatacccctgcctcagtctcccaagtagctgggatgacaggtgtgtgtcaccatacccagctccattagtagcgtttttaacaattgtgggccactgagtaagaataattttttttaattaaaggttattttttaaaaagcacatttgtagaaaattactagcataatctgcctaaaataaatatacatattgaaaaaatgtttgctctgaacaaaaataaatatattcaccacacatacatacatacacacgcacacacgcacacacacacacacacacacacacacaaacattatggaagatttcaagaccaggcaataatttccactcaatccaaaaacaatgcaatcccagagctgtgtatttaggtgaaaaatatatcaggaatgggaggcattcaggtttaattttcatgttttggtagagttaggatgtgacttttcatttaaaaatattctttatttttttgctactattgtggtttctgtattgttactatacaatctgtaaactaaatagtaaaggagagaaaagtgattttcaaagaagctggcttgggaacaggtactattctgggaagatgaaaggtttcacttaatgactggtacctgtgccactctggttattttaactgttaaccttttagcaagaggtttttcttttaaaagacatcctttactatttgggaagctagtgcaatagtacacattgaggcccacataccacatgccaaatatttaaaaggcatatttctagctaaccactgtacatacatatattttttctctcttatttttattttagtttttttccttgtcaacaatttaatgtccacacttatcttctatcatcccactttgacaaataatttcataccttcaaaatgatgtggaagactagattggaatttagaaccgtggaacattgtaattgtacaggcaagtttcttcctgggaaaaaataaaacaggaagaaaaggctgggcagcctctggttcaggaaggaaattcgggagtcccttatagcagcatctctagtacttgggaaccgaacagacttctcggcctgtgaggctggaatgggcccttctggagaacacgacagagtagttatctactgcctttgcccccagggcccaggcaacacttttaccctccattgcttgtctccgaagttaaggggaggagacaatgttttgtttagtgacctcgacagaaaaggtgtcctcctgcaaccactcatttgttactttccttcttcctgaattgcctggacccactcctcctccatttgactggctctgtgcactgatgttatagtcaggaattgtggcttctaaaaatgtacacccgactctacccatagctggccctgtgaacctacatacttgctccactgtgtctccttctcatagagacactcttcctgctgagtctctgccctctgctcctagatccaaatggcatctcctaccctatccctgtatggcttaacctagggaaactctttcccagaggagtcaggtaaggagacggtggctgagcttcttacagacttaaaggagacatcctggaatttaggagtccatccttcctttctgtctccctggcagctcctgctgctgctcaaagtttagctttgtctctcatccaactcagactgttgctggtcctgatggcctctgcttagcagtattagtatgttcttgcattgctataaagaaatacatgagaaatacctttagttggctcacggttccataggctatgcaggaagcatggtggtttctgcttccggggaggcctcaggaaacttttattcaaggtgcagggcaaaaaaaaaaaaaaaaaaaaaaaaaaaaaaaaaagctaccagcactgcactgtgaggccctgatccctgagctaacttcatattattacctctacagcaagtgtctgtgagaacatagatatatttcttatgtgagtacacaatttacagaagaggaactaccctcccaaccaaaacaaaatgtcataattttaatttaccagcaaacctaggttgcttctgtgaaatgatctcatttgctgagttttaaaattgactaaatttcccaatttccaaatgaaaatatttagttatcttgccttgctatgtgtttttggttaatatgatgattaatttttggtctattacttaatatatttcatgattgttgatatggattataaggactcacaaaatagttttcagatgtctttaatttttttacttagtgtagatcctataaatggattaggagtattctattaactcccatgtattcagaaatcgaattggagtggtaaattctgtttgaggtaacaagggatatcaaaggaaaaaaataattttgtgactatgtcttctatacataaatttttcaggcatctttatcaatggcttatactaaagacattttctggatcatgggtgacagacagaagacatgcggataagtggcattgtgtacactactgcattttatcatctggtttatttttaaacttttatttctcttaaggatgttttattaaccggtgcatcaccagattaacagtctctggaacactaaacttaccagaaaatacttgttgattgaattaacaagaaaacaacattagaaaacagtggtggcttgtttttgtctgttgcagtatcttggagagtaaagcctaactctttaattttggccaaaaatataaagaaatacctgagaaacacctttagttggctcatggttccgtaggctatacaggaagcatggtggtttctgcttctggggagtcctccaacacttactggcagggtaattttgaagaagtcatgataagatggttgttacaattaaatgaaataatcaaaatggaagagcttatttagctgtcttccctaaatgaatcactggcaagtaagagtgtgattgattttcctaccagtcaggactcaccccttgaagctataggagggtaaacctctgaagaccatacaatttagggaacactaacacctcaaaaaactctgtaaacttcgttccttccttttctttcttccttccttccttccttccttccttccttctttcctccttccctccctccctctctctcttttctttctttgttcatttttgagacagagtcttgctctgtcactcaggctagagtgtagtggctggattatggctcactgctgccttgacctcctgggctcaagcaatcctctcacctgagcctccctagtagctgggactattggcatgctcagctaattttttcctccttttctttttgtagagacagggtctcatcatgttgcccaggctggtcttggactccttggatcaagcaatcctgctgcctcagcctcccaaagtgctggattacaagcatgagccactgtgcccagccttaagtttttttcatacaggaggaaagaatttgggaaagtaggtgtgtgtgtgtgtgtgtgtgtgtgtgttggttagggagccaacacatttttctgcaaagctttgaattctgtgcctcagtttttcatttttgttatgtgcaaaataaaatcatatcctgctatagatgtaaacctgtgagcggatcctactcaaaacctgattcaaactttgtgtagatctttgtctctctatggcataagaataaattcttctggttttcttccctcagaaaaagggacttagacttcccacaagccttccagaaagaactcacctgcctcatctgcctgaattacctcatagaccccatcactataggctgtgggcacagtttctgtaggccctgcctctgcctttgctgggaagaagcacacactcctgccctgcatgcagggagctgtcacagcaggaagatttcaaccaatattcttctgaagaatctagtgtccattgtcagaaaagccagtctctggcaattcctgagctctaatgaacaaatgtgcgggatccacagggagacaaagatgttctgtgatgtgggcaagagcctgctctgttttttgtgttctaactctcaggaacactggggcacagaaacactggcccactgaaggggcagctaaggaacactgtgtaagtgatgactcagagcactttgaaagctggagggcatcacaggtaaagagattaggaggaagatgaagagcatgaggattaatctattctttaccgagtgtcatgtactgcctaggcatcagtgatataactgttatcctgctatcaaatctactgataagtggctcatttaacttatatgcactcatcacaatgcaagaaatcctctgactgctcctaccatcatggcctctagccatgatatgacttgtctccacagtagcagaaactaatcgagtccctatattagggataagtggcatttatatatatatacaatttttatatataatttttatatgatatataaaatacaaataaattgttatacaatatttattatatacatatatatatacatatatatatatcacaatgccaaaaatgttttgtcttcgaaataatcacagtgcatttggatagacaaatgcatctacaaccaggtgacaacactgaaaataaaattgtagcagtttgaataggggattaaatgagttatttttttcctggggttcaaaaaaagaaacagcaacaaaaagtggtacttaagactgaaagttggccaggtgcagctgcttatgcctgtaatctcaacactttgggaggccaaggtgggcagacaacctgaggtcaggattttgagaccagcctggccaacatggcaaaacaaagttattactaaaaatacaaaaattagctgggcatggtggcaggtgcctgtaatcccagctactcaggaggctgaggcaggagaatcacttgaacccaggaggcagaggctgcagtgagccaagatcatgccattgtactgcagcctgggtgacaaaagcaaaactccatctcaaaaaaaaaaaaaagttctgggttatgacacagaacatatgcaacatgaatatgtcatggttatgaacatgtagactactcaagattgtgtatttttaaaataatagaatacgaggttaaaaaattagcatcacagaatgaaaaataagccacaaactagcagaagataattgtaacacataaaaacaaagacttaaatacaatggtaatataatgatagctattcttacaaagttgtttctatgtcgcaggtactattctgaacaacatacgtgcatcttgaattcgtgaagaattcctatataagaaaagcacaaacaacaacatttaaaatgagcaaaaaacccgaataggaatttcacagaagagaaaacataaatggcccataaacataataaaagatgctcaactacaattctaatcagggaaataaacattaaaaccccaaagagataccacttcatactctaggaaaaacctaaaaggctgtgaatatctagtttcattgaggaagaacaatgggaagactattcactgctggtgagggtgtagattggtacaactgctttggagaacagtttgatgccactcaatagagctgaacacacacatgcccaaagaccaagcaattccactccaggtacatactgtaaaaatactcctgcacatgtagaataggagacactgcataacaaagttaactagaacatgaggctgaggtgggaagatggcttgagaccaggagttcgaggctgcaccagtagctgggactataggcatgtgccaccgtgcctggctaattttttgctgttgtggttgttgttaaagatgaggtcttcctttattgaacaagctggtctccaactcctggcttcaagtgatcttcccacttctgcctcccaaagtgctgggattacaggtgtgagccaccatgcccggccaagttctgcttcttaacttgaggtagatactttgatgtttcattttcctttattgtacagatatactttatattctcatatgtgacacaagtcaaaatttaaaaaaacaatttaacgtttattccctttagatgaatgatgggcaaatttacataatgaattcattactgaaacaatgtatagatttcagactaggaaagtaactatttataaaagaaaagcttaaaacctgaaacagaaacaaaatcctgaaactgtaaaattgagtcaaactaaaatttaaaaaacaaagcaatgatataaagtatcatttgtccaaatgtgttctacaaaacgcttttttcttaaatatgtctgaggaaaaacaggttctaggagtaaaatatgtttgaaaaatgctgggttaaacaactgaacctatgaaggaaggaatagaacttctcaagctcttgactctggaatcttttttacacggcaattaacaccatgcttcttcttggatttgtatttcagataaacacaatctgggaaacattttataatacagagggccacaccagattgaatattgcccccaggaatgaaatgaaaacaggaatggattctccagtaagaggtacccagatatcctaatcttcagtagctgacctaaaccctggacaagtgggatcaaaccccattaccaaatacaactttttaggaactaagtggataatcactctgtgttgtatgaacatgtgggcagtgtgtttcctacacagcttaaaagtgcaacaaaaaaagatctaggtgtcatgtaaagaatttctaccactgttagggtaatggtggactgacaggcagagggtcttagatgtcacttaagtaaagttcaatagaagcttccagcacagatattcatgtttcgaattggaccgctcagttaaaaagtttttccattagacttcccctaatcaaattagaaattatctaattttctaataaagttttccccaggctcaagaaatctgtgaactggacctaagaaattcttcataatgtgcttttattaccataaaagatgcacatttattttaaaaacttctctacaccactatcataaacctttgaacacacttatttcttttggaagctaacttctgagtggtaacgaaatgtattcttaagaaaaaagtctgacacaatgcctttgtgtcttaaaatatgttaaaatattatttgaaaagagtcaaacatctgtctgttcagggtatcacagggcgtcaaactggaaaatgtggcactgccaggagtttctacctggtgaaggttggcagacttttctcttcagagggctcttgacagggtagcatccattatcttgccaatttaccaaaacctaggcccaatcctcagtcttataggttcagaattttatttttatcatcatcaatagcgtagctacattgcttagaagaaaacaaaaataaccatgtttcaatagaaatcaggatatagatgtattaatacagaatgacaaatataactgtgacagaaataggaatgcctgtttatggtcatatacggccaatactttcattacagccaaactcatacatgcagccaaataagaggcccctggatacacagggaatcagaataaaaaaagaagaactgaacatttaatagtcttctttcattcaatcaataatttttttaattaagcaactactatgtccaggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagttccaattaaataacaataaatccaaataatgaaaaataatgcagccctttaagaataagcacttgcaagccgtaattcatgacatgggaaaattatcatgatggaaaaagaagcaagctatgtatagtgcacgatcctatacacacacatacatacataaatatttcctatccctttatatgcataagaaaacaagcgggaggaaagtcatatctttagtcaaatgttgtttactaacgtactattaatgattatcttttctttttctttatacctttttgcatttttcaatttcctaaaatagccttacataccttttatcaccaggagaaaaattacttctaaagtaatttcagtcaacatgcatactaagaactcttcagatttatctgttagaagctgtgcatgaatgccagtccttgcacctgtcttggaactcacagagagctcttttcccatggctttaagcaatactcaaaaagactagcatacctgaatttcctagtcctatgtttttttcatccaacagccagtcttgtatttctagctgttttctaaacatttcaaccaaaacattttacagataactcatacagtcatcctttgatatgcatggggaattggttccaggatcccccttgtataccaaaatccatggatgctcaagttactggtataaagtagtgtagtatttgcatataacctacacacatcctcctatatactttacattatctctagattacttaataacacttattacgatgtaaatgctatgtaaatagttggtacaccacgttgttttttatttgtatcattttttatcattgtattgttttttctgacaattttgttccacagttgtttgcatcagtggatgcagaacccatgaatatggagagtcaattgcatttcattatgcccaaaggtaaatgcataactttttccgcacagctaatcttctagcaaccccattgttgtccatggcaagcaggcgtagttaatctcgccctttcccgtttcaggttcattaaaaaactcttgtcaaagtctctttcatcccaccttattcttcattctcacttccatcagcatatcagtccaggccctagtaacattaatgttactaatggcattgttagtaacattacttaccagcattcaagtgggtcttcctgatgccattctctctcagcctgaaatcactgctgtttatatagaacttgtatgatgtcattcattggctcaaaaacttttaaagccttcctttttctaccaccccaatctaaatttctatgcctggcttttattaaaacccgtaatttggcaccaccctagctatttaactttattttccactattcgccagtctcctccctcatcaatgagaagacataccataatcaacctcaccactaacccttggaatatctaaagttaaaaatggtccttcctttcccctttacttgtatttaaagaacctgacgaattattcctcctctgctaaacttttcacaatttcttcaacctcatttatgtttcacattttcagaacatatcttgccatttattaggaatctcacaattaggcactctcatgtagatagatttacaatcatgtatgttgtcatcttctattaaattccatactccttgaaggcaggagccatgccttattctgtcctccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccggagtgatgaggtgccctataccagggataatggagacagagttcttgggattcatcactggggtcctcaaagcatcttccaagggcataataaggaaggactcaaacacctttgaatcttcgtgagaccaggcatgaggtcttttgaaagagttctttaactggagtgaatgtcaaagagaagtataataaaataaaagacctgagtagggtcccccttgttcataaaatgacactacctaactcaccaaatctcactgagccttggtttaactcaagaggttccatgccactataagaggtggtaactgccaactgataggaaatattttcatatgcatagtcatagtgccccatatttatgaacttcttaagagtcttcaaaaagctttctatatacattatcctttactttctaacttttctaaatacaaggtgagagagacacaagtgttctatcaaaacagaatctttgccgggcacagtgactcacacctgtaattccagcactttgggaggcagaagcgggtggctcacttgaggtcaggagttcgagaccaacatggccaacatggcaaaactccatctctactaaaaatacaaaaaattagccaggtatggtggcaggtgcctgtaattccagctactcgggaggctgaggtaggagaattgcttgaacccaggaggcagaggttgcagtgaacagagatcacaccactgcactccagtctgggcaacaagagcaaaacttcacctcaaaataaaaaaataaaaataaagactttggcaaggaccatgtcccacccagaatggtgcctgcctttttacagtttttcaggaagaggaaacattttctgcttctcttgctgaggttttttttaaccacccattaggaacgtatagatttcaggatcgaacactgggattccctcagcactaaaggagtaaaattgcaaacagagctgaaagtgcaatgtggaaaggtcaggctgaggaaggttcttagccagtagaccaagggcagaaaggacactgcctcctcagtctcccactagggaacttgtgattctcgtcccctgacctcagaattccttgtcatgtttgttttgtctccaagggaaggttttgaattacagaatttaaggctagagtgggcctcctgcagttaacattaaccctctctctccttcactggccgaggtgaagtccgggaccatgtagttctgacgtccactctctcgggggatcaccagttcacccacctcacctggcaagctgggccctagtttggcaacaggcatcttccacccacctgggaggcagggttcaacactctgcctctgaccttttttccttcctctgccacctgcttaggcagccagaaggggttgtccagccagcacctgggctttggtgctcctcaagcaggtggaggaagtttcaggcacctggctcctcaggtgtctgccatccagctgctcttcaggcctgcccagcagagctctcttgatccagctagaactggccagaactgactcactcaggaatgtgtagactttggcatcaggggcagctttaatttgcacaatttccaaataccacttttttcttctttttctgatgagtcatctccctagacttgcattttaaagagatagatagttatcaggttccagagaagacatggtagaacatttatatctcaaagacacagagctgagacttcaggtttagatacaataatttacctaaaccaaaaaggaaggtgtaggtaaagttctagtcgagacaggatggccaggaaaaacaccttaaaccaagggatggcttgctttgctgatttaagccaatggcttctttatcataagacttcccagtgatttagtcctccctctcttccagtgcacagacgcatgaccctccttacaaataaaaatgttctttatagatgtaaatttattttacaaaaatgtttcaaaataactagatgaaaatcatccttatgccagaaagacttgttttttttttttcattactagaaatgaaacagtaagtatttgttgtattgacatactaaggctaagacctatgtttaacaagaaagcctaataatagcactgtggttagactgtagcctatttttccaaaccatcattttattattaaggaaagaaaggatcaaatacctttcattcatctgatatgatcctttaaaacacattccactaataagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaaatcatcagcccccttcatgaccttaaaaactccactctgacctaattattgcaaacctatatacaacaaagtgaaaggattaattttcattcatcaacctctcaatcccagattttcaaagaaaaaacctatgtaaggaatacttaccaaaaccagacaggaaaattagagccttcatacttaagagtcaaatttgtttcactacagccaggtcacatacaattacatcatttggttcttcatacactctggaactgaccaggacagagtttagcatagaaaaactgtaagaaataggttccaagacatagaaattgcaaagtccaaaatgctatgaaaaaaactaatgtaaatgagagactcccctccctttgttttaaagaaatagacccatcagggaaatgcaaatcaaaaccacaatgagataccatctcacaccagttagaatggtgatcattaaaaagtcaggaaacaacagatgctggagaggatgtggagaaataggaacactttcacactgctggtgggactgtaaactagttcaaccattgtggaagtcagtgtggccattcctcagggatctagaactagaaataccatttgacccagccatcccactactgggtatatacccaaaggattaaaaatcatgctgctataaagacacatgcacacgtatgtttattgcagcactattcacaatagcaaagacttggaaccaacccaaatgtccaaaaatgatagactggattaagaaaatgtggcacatatacaccatggaatactatgcatccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcacacaccagggcctgttgtggggtggggggagggatagcattaggagatatgcctaatataaatgatgagttaatgggtgcagcacaccaacatggcacatgtatacatatgcaacaaacctgcacattgtgcatgtgtaccctagaatttaaagtataaaaaaaatagaaaaataaaaaaagaaagaaatagatgttctgaaaaaatatacacaatttttacagacaaatacatttataagttgtttttatcttaaaaattggggatatttcatatttataactaattattgagccttaagttttcttggccatttctaggctaataaactaagaatcatgtaaactaagccaaaatagaatagacataaaagtcctgaacacttcaacttcctatccttcacgaagtatacctcgcaaagctcatttgagagaggaaaagctttcctccaccctctgttttacagcgctgaggcttctcatcacatttctatgacttgtagcttaaatccatgttacatggtcactggcattgttaggacttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataagtctagaatttagaaagtatatttccccactggattacatttttggaaatattattttatatgtgcacaaatattacaaaatcactgtagacacctgcaaactatattatctttcaaaggcaatatttatattaaactggtataacaaaattgtttggtgcattttttccagtacattttgtgtatattacatgtttaacctttttttatccagcaaataatttttgagtatctactaagtgctaggttctgcattactaactgaatttaaagagtgaaataacagacatggtctcagacaataaaattaacattaggtcacctatttatatattttaaaatggtaattatgaaaactttctgagatttttaactagataacattataataacacacttgacgttgttaatatttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaatgaaggcagaagagtaacaataaatctaatattttaaatgcttatcaaaagaaagtaaacacattatttcagaatactgagttcaataagttgacctacaaaaaaagtcaaactgacagtattactgaataaggaaaggcccaaagagacaaaatactttttaatttgtaacctcagtatgacacaacttaccctaactataaagaccctaaattaccaagatgggtgcttataatatggagagtaaaaaaagtcatttcacttttagcttttttatttctctcagaataaaaagtgtataaggagttgataaagaagttgatactataagttggtactacaatgacagcactttccaagaaaagacttttttctctcttacaaatatcatgttagcagtatttgttttctccagaaataatgaggaaataaaaacataagtatgtgggtaattactgtagtttcttaaagaaatgagttaggcaacaggctaataatgtatacttcgctggcttttgaatgccaacaatcatattctttataaggcacagagaagatttttctgaagaataagtatgtgaacctgaaaagtaatcaccacttggtagtgacaatatggatagggtgaagggcgtcaccaagaagcaatgaaaagatacatttgcagttaaatttgaaaaccatgatgtttaatacatatagtaataaagaatactttctcctatttcaaaattattttagaatttaagatagaagctaaaatacctagggataatgatatgactatcaaaaattaaaaattaaaggacattttgagtattataagttaagaatgagaacttattacccaatgaacaggggataaatcattatgctccctatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatattataagggccaccatctaaatattattatgtaaataatttagtaccattccatttgcttttgtagatttaaaaatgtaaatggctttctcatattaggaaacatcatttttcaaaacccagataaacatagtatattgcaagagagtaattattttctttattaaaaaagaaatactggatgctaagtccaaaagacataaattattttatactaataactactaaaattttattcattaaaataaaaaatcaaagattttaaaatgatcttcaaatgattaataacatgttgaactttttcttctttctgtaaacctttttgagtcttaaaaatactaaactatacaagcaatattaaatagtatataaacttggattaaaatattcaaatttactagaatgtggacattggaaagaatgaaaataaacagaagcataaagcagcagatataaaattaagaaagcaactaagagtgcttaaagtacatattcatctgtagtctaatttctaccataaacaatgactcttctcagtaaaacacaaattgttcatgaagggaaaaagcatgttgtattagagaatattcaacataacttttttagtactaacttgtgcctgaagtattattggtttttctattatgaacttatgcacttgataatttttttcataaagactgtatgtacaactccattcaaaagcagttgttggtgggtttttttttttttttgagacagagttttgctcttttcacccaggctggagtgcaatggtgcgaacttggctcatagcaacctagcaacatttgcctcccaggttcaggtgattctcttgcctcagcctcccgagtggttaggactacaagcatgtaccaccatgcctggctaattttgtgtttttagtagagacatggtttttccatgttgactagactggtcttgaactactgacctgaggtaacccgcccaccttggcctcccaaagtgctgggtatgtgcaagagccaccatacccggcctcaaaagcagtttttaaaagcaaacacaatataacaccaaagttgaaaaattcatgctcacccaaggatgccaggtttaataaattatttatagaatactgcatcaaaaataagacaataacccaaaatataccattaaagatgtatccactcctacaactagagataattaatctatctggtagcaaatgatacttcagtcagtttcagcatgtctgaaatctttaaggacaaaagtgataaaacatgacttcattcttcattagactcttagaacacttgaaggaaaatgatttctgaagcacaaagaggtaaagaagtgtaatctttcaaaaagatattcagtgttcaaaatccaagagtgcaatatcaggcagggtgcggtggcttatgcctgtaatcacagcactttgggaggccatggtgggtggatcacctgaggtcaggagttcaataccagcctggacaacagggtgaaactctgactgtactaaaaatacaaaagttagccaagcatggtggtgtgcacccgtagtcctagctacctggggggctgagacaggagaatcgcttgaacctgggagctggaggttgcagtgaacccagatcatgccaccccactccagcatcagtaacagaatgagattccatctcaaaaaaataaaataaagagtgtaatatcatatcggtatacatagataatatactgaatgaaacaaatagaataatttgaagaggtatcttgacgaacaaggagtcattagaaaggttgtattcatgtctctgaaggaaattgcagtgtgagaaattaatactttgactactatactaaaagtttattgctaacatgtattgagttattaacatgtgttaggcagagtaccatataatttacaagtgttatcttatttattgtaggtaaaatgtaattttgaactctgggagtataaatgaattagatagaataaaattctatttaaatggccatcagtaaatcggtatctaggaacagggtgatacagtgcccaagttttctattcttactaaatgttgtgtttcattttcaatgttttcttggatattgctcttttttggtgactgatttttttttattttagaaaactaataaactgactcttcttggtactgactcttgggttttatagaagaaaaagtaatcaaattctgtacatttacctttacctcattttttctcttttaaatttaattgacatataataaatgtacatgttatgggatacagagtgatattttgatatatttatgcaatgcgtaaagttcaagtcagagtcattatcatatccattacctaaatcatgtattatttatttgcagtgagaatattcaaaatcttttatttatttgaaaacacacaataaattcccgttaactacagtcacccaacagtgctgtagagaactagaacttcttccttctctccagctgtaatttcgtatgtattaaccacatttttcttatactcttctttctcctactctttccaggatatggtaaccaaaactctactatctacttctacgagattaaaaattttagcttccatacataagtgagaacacgtagttatgtggtgtttatgtttctatgcaaggcttatttcacctaacataatgccctccacttgcattcttgttgccacaaataacaggattttgttctttattatgactaaataatattccattatatatgtatgtcatatttctttatccattcatctgttgatggacacttttgttgattccatatcttggctattgtgaatagtgttgtaataaacatgcgggtgcaggtaactctttgatatactgattttctttcctttgaatatatactgaaaaccatatgattaaattaataaacacaataaaagcgtttggcaaaattaaatattcttacatgacacaaaacctctcgacaatttagtatagaaaatatatgccttaacacagaaggacataaaggacaaatctacagctaagatcatactgagtgtggaaaaggtgaaagattttactgtgaacaagaaaaagattttactggagcaagaaaaagatgcctattttcaccaatcatatttcacatagtgaaagtcttagccaggacaattaggtgagagaaagaaataaaggacatctgaattggaaacgagacagtcaaattgtccctgtttaaagacaatgtgatcttatacacgaaaaaaaaaaaaaataagacgctaccaaaagcttcctagggtgatacataaaattaataaagttgcaggatataaatcaacatacaaaaatcagtagcatttctatatattgatagtaaactagctgaaacaagaaattaagaaagcaattccttttacaatagctacaaaaatgtacttagagataagtttaaccaaggaagtaaaagatttctacaacaaaaatgacaaatattaatgaaaggaatgaaggaaaacacaaaaaaggaaagacatccacgtttatagattgaaataactaatattcttaaaatgacccactatcccatgtgatttacaaatttagtacaatcactagcttgtatttttaaaagcacctttgctgcatattcttaagatattcagtgacaatgcctggattaagtttgaggtattattatatctattttatattgggcacaatataatattatcagaggtaatggttttgattggtcctaggtcatacagtaatatatacattgtgatttatagacatgctatcttttaatactcaggcatttagaaagttcatttagacaaagttataaaaacttgccttcctttctgcctatatcacctaaaaatcctaatttaagaggtaataacattttttatttgatatacaatttatcaacaaaataaaaatctaacaattatcatgtgcagagtgtgaaaatctcatcagattaaggaacacaaagacatctttttcatatttcgaatgtaaaactcttttggaaactgttatttttagaaacagttaaaaacattttttcattagtttttcatgtaaaattgtgacaaccagcatgaaataactgtcatcacagaagcatggtatattcaattccaaaacatattcttagtaagttttaatatatttatgtattatttatgcttagattgtaacccataatgtagatattatttttccttcaactcttaagaatattcttaaataataaaattaaaatgaattataatttttgttggttgggaaaaagaatagacacacacgtgacagtgcatcacttcacctcatcatttcatctcatttcatcatttcatctcatttcatctcattttatctcatctcatcatatcatctcatcatttcatctcatcatttcatcaaatctcatctcatttccattatttcatttcatcatttcatttcactatttcatttcatttcatctaatttcatttatttcattatgtcacttcatatcatctcatttcatttcatctcatcatttttcataccattattcatctcatcatttcatctcctcatctcatttcctcctttcaacatttcatctcatcatttcttctcatctcatttcaatttcatttcattatttcatttcatctcatttcattatttcacctaatttcattatttcatctcatctcatctcaattcatctcatctcatctcatcgtttcatatcatcatttttcatctcatcatttttcatctcatcatttaatctcatttcattttgtctcatcatttcagctcatcatttcatctcaccacatctcttcatttcatcatttcatttcaacatttcatcatttcatctcatcatttcatctcatctcatcttccaatttcatttcaatatcatttcatttcatcatttcatctcatttcattatttcattatttcatctcacttcatctcatcatttcatctcatcatttttcatctcgtcatttcatctcatcatctcatgttatcatttcatctcatttcttctcatcatttcatctcatcattttatttcatctcacctcatttcagtttcattatttcatttcctttcactttatttcatttcatctcatctcatcatttcatctcatcttacctcatttcatctcatcatttcttcttatctcatctcatcatttcatcatttcatctcatttcatctcatctcacctcatcgcatcatttcatctcatcctttcatttcatctcatcatttcatctcctttcatctcatctcacctcagcatttcatcatttcatctcatcatttcttatttcatctcattttatctcatcatttcatctcatctcatctcaattcaatttcctttcattatttcatttcatctcattcatttcatctcatttcattacatctcatttcctctcatcattacatctcatctcatctcatcatttcatctcatcattgcatctcatcatttcatctcatttcatctcatcattcatctcatttcatctcatttccatttcatttccatttcatcatttcatcatttaatttcatcatctcatttaatttcacctcatttcattttttcttttcattatgtcatttcatttcatctcattacatggcatctaatttcatttcatctcatttcatctcatcttttcatctcatcatttcatatcatctcatcaactcatttcatcttatctcatcatttcatcatttcatctcatcatttcatctcgtatcttctcatctcatttcaatttcatttcattacttcatttcattatttcatgtcatgtcatctcatcatttcatctcatcacatctcatcatttcatcattttatttcatcatttcatctcatctcaattttatttcaatttcatttcatttcattatttcatttcatttcatctcatgagttcattatttcattgcatttcatttcatctcatcatttcatctcatcattcatctcatcatttcatatcatcatttattctcaccatttcatttcatctcatctcatcatttcatctcatttcatctcatctcatttcatcattacatcttatttcatctcattttatgtcatttcatgtcatcatttcatcacatctcgtctcatctcatcttttcatctcatcatttcatctcatcatttcaactcattgcatctcatctcatcatttccatttcattattccatttcatcatttcatttcattatgtcatttcatctcatcacatttcatctcatctcatttcatctcatctcatcatttcatctcatttcatctcattatttcatctgatttcatgtcatcatatcatgtcatcaattcatctcatttcatcacatctcatcatttcatctcatcatttaatctcatttcatctcatctcatcatttcatctcatcatttcatctcatctcatcattgccatttcattatttcatcatttcattatttcatttcatctcatttcattattgcatttcattatgtcatttcatttcatctcatttcattacatctcatttcatctcatttcatttcatctcatcatttcatctcatttcatctcatctcatctcatttcatctcatcatttcatctcatttcatctcatctcatttcatcatttcatctcatcattccatctcatctcatttcaatttcatcattacatttcataatttcctttcattatttcatttcatttcatctcatttcattatttcatctcatttttcatctcatcatttttcatctcatttcatctcatcatttcatcttatcatctcatctcatttcatcatttcatcgtattgttcatctcatttcatctcatcattttatctcattatatcatctcatctcatctcaatttcattatttcatatcatttcatttcattatttcatttcatctcatcatttcttctcatcatttcatctcatcattttatccatcatctcatctcatctcatctcctttcaatttcttttcaattttgtcattttgtctcatcatttcatctcatcatttctactcaccatttcatctcatcatttcatcccatcatttcatcatttcatctcatctcaagtcatcttatcatttcatctaagtgaaatgatgtaatggaatcatgaaatgaaatggataggatgccctcagtgatgttaaatttaaaaattgttttcatgtattcatttttatatttatatgtatttatatttctatttacttatatttctttttacttattttaaattatatttttacttatttatttatagacaaggtcctgttctgtggcctaggcaggaatgcagtggtgcattcaaagttcactgcaacctcgagcaaacctcccaccttagcctcccaggtagctgggaccccaggtgcgtaccaccacacctggttaatattttattatttgtagagatggagtcttgctatgctgcccaggctggtctcaaactcctgggctcaagcaatcctcctgccttggcaacccaaaatgctgggattacagatatgagccacagtgccaaacctatttatttgtttatttatttaataaagaaaaggtctcactatgttgcccaggctggtcaactcctgcactcaaatgattcttcaaacttggcctctcaaaatgttgggattacaggtataagccaccatgcctggcctaaaaatagtattatatttttgcattatataattttcaattaggtaatatgaatattctgtacaggaaatatgcccttaattacataggaataaacatttgttatactgagaataatctaatagagctaaaaataaaaattaatttggagaggtcattagatacacatacattcttatgtttatacattctttcatatattcatatattcttttaacagtatcaatggtttggagttacgtgtacaaaaccatgacctatatgtaatacaactaataacaagcacttacaattcaaggcatattatatacaaagttttaacttctcatcatcagatttcgttttttttctttctgttttggcagatactatgaacacaacattcaactcacagacactatggagcccttactaagcataaagtactgtgaaaggctagggctaggacagaactgagacagggccagggataggacagaactggggcagggtcatggccagagaaaaaccaggggcagggtcacagccagggacatgagaggaccaaggccagggccagatgtagggcagaaccagggccagggcagggacatggcagggccagggccatggcaggatcagggccatcagaaggccagggcagggctagggtagcacagggccaaggcagggcagggtcagtgtagagcaaggaacgggccagggtatggcagggcagggacagggaggtccagggccagagtcaggtccaggacatggacagggcagggccagaaatatggcaggaccagaaaggggacagggaaggggcaaggccaaggccagagaaggaccacggtaaaaacatggccagggagggtccaggacaagggcaaggccagggcagaaccagagccagggcaggcaaaggcagggccagggcagggcagggccagggcaggtcaacgccagggtagggtagggccagtgtagggtgagggtagggccagggcaagttcagggccagggcaggactaagatagcacagggccaaggccaaggccctgtactaagatagcacagggccagggcagggccaaaggaggggccagggccaagcatggccagtgtggggcctggggattgtcagggccagggccagggtgaaggctgagccagagacagggccagagcaatggcagggccagggagaaggcagaaccagagaggatccagagaaacagcagggccagggcagaacaaggaccaggataaggcaaagccaaggccagggcagggcaacgacagggcagggcaagaccagggaagggcaaggccagggtagaaaaggccagtgtacagccaggccagggtaggaaaaggccatggtagggccaaggccaaggtggggcagggctagggtagcacagggcatggccaaaaacagggcagggccatagcagtggcaggactagcaacagggccagggtaagtgctggaccagagcatggtggggacaatacagggccaggacagatgatggcaaggcaggtccaaggtcatttcatggactcggtaggcctggggtcaggccagggcagggaaagggcaaggccagggagaaggctgggccggggccaaggcactgccaggacagggcaggaccagtgcagggtgagggcaaggccagggcatggatgggcagggcaggaccaacgaagggccaggagagggccacggcagggtcaaggccagaacaagggtatggctggggtcaggaatatggtagggcaagggctgggcccagactgggacacacagggcagagcatggcctgtacaaggcagggccagagccaggccatagagatgggagggcaacaccaaggcagagtcagggtagatccagggctgagcagagtcagggcgggtccatagtcgaggcagagctagggcccaagcagggccatggcagcaccagggcagaggagggcagggcaatgcaggactgggccatggcagtgcctggtcaacttcggggcagggccagaagcaggacagggccagggccaatgctcaggccagggacagggcatgacagcaagtgccagagcagggctgggccaaagttggggcagggcaaatcagaccaggacacctccaagtccagctctggccctgccttggccctggccccttcctgacctgaccttgtccctggccctgtcctatccatgccctgtgtgtttgaccagtgttttataaccagaatcctacaagaaacttaaatcagctctttttgtgcatttttagtagagatggggtttcacaatgttgcccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacagtactggaagcagagatagtattagttaaaatttagtgattatttactgtaaatattattactattacaaacaacatagtatagacattattaccactactatagttatcttaaaaatctaaaataaaaattttacataatagcctaatgtaatctcccctgctctgccccggctcagccctagtgccggctctgcccctagtcctaccacatccctggccctgacccttccctggtcctgccgctgccctggcccttcccatcttcaggccttaccatggccctaccctggtcctgaccctggccctaccccagagaaggggtatggcagagccagggaagggctggggcaaataagggacaggacacatccaaatccaggaaagggccagggccatgacagagccagggcgagtccttggcagggccaggttccaggccagggccaggaaagggtcatggcagggtcactgtatggccaaggtccaggccaaagccaaggcaggggcagggtcaggcctgcataagggcaggaccagagccagtgatacggcagggccagggccagggagggccagggctgtgtcaggacagaacaagagcagagcagggcaggaccagagccaggccatagagagagtagggcaaatgccaaggcaaggccagggtagtgccagggctgaggcaaggtcagggaaggtccagggctgagtcaaggctggaacaaagacaggggcaaaggccggggcagatctagggcacaagcagggcaggctagggcagggcaatggcaagaccaggccatggcagggccagcccaggatagaacagggcacaggcaggacagggccagggccatggctggggcaggacaaggaccaggaccagggtccaggccagggcaagggtatcaccagggcagaagtagggccagaaccagggtctgggcaggaccaaggagagtccattgcagggccagggttcagaccagggccagagcagggctgggacagggccagggccaggaccaggaaagggcaatgtcaggataagagccatggcaggaccagcaaccaggctagggccaggacagggacagggacagggtcagggctagggccagaatagcatgccagggtagagccaggccaaattagggccaggacagggtcaggaccagggctgggccagggtatggccttaagtagtgaagggccagggccagggtccatgccagtgccagcgctggtccagggcagaggcagggccatggccaggtcaaggacaaggctggcagggccaaggtctgggtcagggtcagcacaagaccaggacagagccaggggagggacagggccatggtagggccaggttaaatcagggacaagacacctgcaaatccacttcagggccagggtcagggcagggccagttcagggccagggccaagacagggccagggccagggctgtcagggtcattggcaggcccagggccatggcaggaccagggtcaggagcaagggtcaatgccaggccaacgccacagatacgaccaggtctgtgctagggccagtgtgagggccaaggtggggtcagggcagggccaaagggagggcaaggcaagggcagggtggaacaggcccagagtagcacatggttaagatagggcacgaccaaccagggcaggtctatggctggggccggggcatggaaagggccggggcagggccagagccagggcagggcaaagacagtggcagctccagggcaggcccagggttaggaccacggacatgtccaaggccagtgccagggcaaggacaagggcaggggcagggccagggtcatctaagaaccagggacaaagccaggcccagagcagggccaggacaggtacctggaagggctagggtctgggacagggccatggcagggccagggccacaaccaggtctgtgctatggccaggtccaacacagtgcccaggtaaggctagggtgaaggccaaggtagggccagggcggggtcaaagccaggcgagggccaaggcaggaccagggctggaaaggcagggacaggaaagcatagggccaaggcagggcagggccaggccagtgccaagacctgggcagggccagggaacagccagggcagggccagggccagggccagggccagggccagggcctgggcaggaccaggtttggggcaggagcaaaacaagggcaaggacagtgcaggatcttggcacagccagggcccaggacagtgtcagggcagggccaaggcagggtcagggccatggtaagaccagcaacagggctggggctaggccagtgacaggaccagagtcagggcaagggccagagcagtgcaaggccagggtagggccaggcatttcagggtcagggccaggggagaaccagggcaaggtctcaagcagggaagggccagggccagaacaggtccagggcagggccatgacagggccaggggctgtgttagggcaaaggcagggccagagcaaggtaagggtcagggccaaggccagggtagggacagggcaagaaatatggcatgaccaggggcaattccaaggccaaggctgggccagggctgagtcagggcagggcagggcagggcatggcatggccagtgcaggacaggacaagagccggtccacagagagagcagggctgatgccaagaaagagccaggctagtgccaaggctgaggcagtgtcagagcatgtctggggcagggccggggccagggccagaactgagccagggcacagccaaggcagggtagggcagggaaacagcatggccgggtcagtactgggacagggcagagcagggcaaggcaatggtaggggcagggcagggacaggccaatgcagagccacgttatgccggggccaggacacctccaagtccacttcagggccagggctatggcaggaccaagaccagggccagggtcagggccaggtctgtgctagggccagctccagagcagggcctagcaaagactagggtgagggtcaaggtaaggccagggcagggtcaaaggcagagtagggccagggcagggtgatgacacatccagagcacagcagggcagggtgatggcaagaccaggggcagaccactgccagctcagggccagggaaaggccagtgcagagccaggaaagggtcagggccaggaacaaggcagagcagggccagggccatggcagagtcagggcaagtccttgacaggaccaggttccaggccagggccagggcagcagcaggggcagggcctggataagggcagggccagggatatggcaggaccagggctagggccagggccaggccatagtgagggcagggcaaaagtcgaggcagggtctgggcaggtccagggagcggccagcaccaagcagggccaaggcacaaccagcacagcgtaaggcagggcaatggcaccactgggccatgacagggaaggtcagtgccaggagagggcagaacaggcaggcccatggtggggccagggcagggatgggccaaagcaggaccaggacatgtccaaggccaggtcagggccagaacaggattaggaccatgaccactggcagggccagtgccatgacatgaccagggtcaggacaaggggcagggccagagccagggccagagccaaggtcaggccagtgcaggttcagggcagggccagtgccagggcaagaccagggcagggacagggtagcacagggccaagacagggtcaggatgggaccagagctggacagggccgagacagtccaggtaacagtagggcaggtacagggcaaggcagggcaaaaccaggcccattgccaatgcaccagccctccctacaaggctcctacaacctggccactgctgcagcccgtccatcgctgtaagcctgaccccaaccctggctgcagccgcctgccctcctagcgcggccgctctcctaccgctctggcgcactgcagtctccattgctgccacccacccgcagcgaggcaagtcatggtgtcacaggctctaggtgtctccttctcctcctggcacggagcagctgggcgggcaaagccagaaaagcctagaggaagatgtaaggggtggaagggttagagcctcaacttgtcgtgctggccactgggtggcaggggccagtttcagcaaaggccctcacacccaccctccaaagtccagcctctccttttggcccaagctggctgggaactggggtctggggtgggtgctggagacaccacagcacccagctccccactccacaggaaccattgggcccaccagggctgcactccttggggaacaggagaagcagaaaaattcagacccagccagccctctgcacccaggtgccaattcctgttccggacgcctccacacacagggccctgtcccccgtggtgtccccaggggtgcctggcagcctctgaggcacagacccagagtgcacaggcctaggaaccacggtaggtgtgggggctctgccatgctcaggattcccacacaaacgctgcgtgcctgccgcactccagtaggaccaagagtgggtcgccctctggagtgtggagtcagggagaggagaaccactccttccttggatgccaactctgctgaccgccgccagcagtgcagcccctgatagcaccgaacttgcccgccctccacagctagtcctgccctcaatagcgccccccacctccatcccccaatgcctccagtagcgtatacccgatagtgccctaacctgtcctcctccatgggcattgcagccccagaaagtgcccataacccaccctccctgccatgggcagtgcagccctgtacagtgctaccaaccagtagccctaatgcaggcaatgacaacctggatagcgcccccaacccaccccacactgtgaaaggtgcagccctggataccccctgtcataccactctggtcgtgctgcagtctctgtcaccaccaccaccaatcacagtgaggcaagccagtgggccacaggctctagcacccagcagccaggcacggagcagctctcgccgatggctggctcctaccactctgaccacgctgctgtctctgtggccatcttctttgactacaaaagaataaaactaggtatcaataagaagagtaattttggaaacaatacaatcacatggaagttaaacactaccctcctgaataaatgactagcgggtaaatgaagatactaagacagaaattcaaaaatttcatgaaacaaagggtaacgaaaacacagtataccaaaacttgttacgcagaaagcagtacagaggcagagatttacagctataagtgcctaccatccaaacaaaagaaaaacttcaaataaacaatacatcttaaagaactagtaaagtaagaacaaactaaaccgaaaataagaaaataaacaagatcgtagcagaaataaaattgaaagaaaaaacacacaagattaaatgaaaagttggttttctggaaagcaaaacaaaattgacaaacttttaaccaggctaactaagaaaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttgaacaatgaaaacatccaagaccagaacagatcggtaaaaagtaatgagattgaagccatcagaaaaagtctcccagtaaagaaaagcccaggaactgatgtcttcactgctgatggcttcacaccaaacaatttaaagacctagtacaaatcctactcaaactattttgaaaaacaggaggggatacttccaaacttattctatgagaccattattactgtgataccaaaatcagacaaaggcatcaaagaaggaaactacaggccagtatctctaatattgatgcaaaaatcctcaacaaaatacaagtgaatcaaattcagtaatacattaaaaagataattcatcatgatcaagtgggatgtatccctgggatgcaagggtcactcaacatacaatgtgatacatcatataaaccgaataaatgtcaactgaaactgaaaaagcatttgatgaaattcaacatcccttcatgctattaatcctcaaagaaacgggtacagaagaaacatactgcaacatagtaaaaactacaggaaagacacccacagctagaatcatatggagagaggtccaggctgcagtgagctgtgatcccaccactgcactccagcctgggcaacagaatgaaaccctgtctcaaaaaaaaaaaaaaaaacaaaaaacgtaaaaagaggtatgagcctcttttataggtacagtgactcacatctgtaatcccaacactttctgggaggctgaggtgagaggatctcttgaggccaggagttcaagatcagcctgggcaatataacaagaccctttatctacaaaaaatttttaaatatttgccaggtgtggcggcacgtgcctgtagtcttaaacaattatatgacccagatagtgtattccttagggatatacccaagggaaatgaaaatatacatccacactaaaatttgtacacaaatgttcacagcagcattgtgcataatagccaaaaattggaaaaaaaactcaagtgcctatcaacagaggaactgataaaatatggtatatccattcaaaagattactcagcattaaaaaagaatgaagtgctgatatatgctacagcatggataaaccttgaaaacactgtgccaagtgaagtaagtcaatcacaaaagaccacatgtagtaagatttcattctgtgaagcctccagaagagctaaactcagagacagaaagtaggctagttattgccagggactaggggaaaagggaataaggatgactgctaatgggtatgggatttcttgtggactgatgaaaatggtctgaaagtatctagatacctgtcttgtttgtgcgattctgtgaacatattataaaccacaaaattctgcactcaaggggttgatttcatggtaggtgaatttatctcatttatctttatctcaataaagctttttaaagacacttaaaaaagacatctgtataagctacaaatataacacactgagagactaaaatgcttaatttttccatttttcttcttcagcgcaatctcaagtccaaaagtctttccttcctatatatgcatattttgtccagtgaaacaagaaactctattaacttttttattagaaatttaaaaaagccaggtgtgctggctcacagctgtgcttccagctactcagaaggctgagacagaaggatcacttgaggccaagactgggagttcaagaccagctgaggcaacatagctagatcctgtctttaaaaatatttttcaggccaggcatggtggctcatgcctgtaatcccagcactttgggaggccaaggagggcagatcatttgagatcaggagttcaaaaccagcctggacaacatggtgaaaccccatctctactaaaaatataaaaattagccaggtgtggtggtgggcacctgtagtcccagctacttgggaggctaaggcaggagaattgcttgagccgggagggtggaggctgcagtgaggccaagatcatgccattgcactccagcctgggtgacagagcaagactccgtctcaggaaaaaaaaaaaaaaaaaaaaaaaaaaaatatatatatatatatatatatatatatatatatgtaaatatttttaagttaaaaccctactgaaatgaaactaataaaataaaattcaagttaattaaaaaatagttcctgaaatattaattttcaaacaattctattttagctttgactctgaacaaaatataaacctcaatttcaaaatatcacaaagattggctgggggcagtggctcatgcctgtaagtccagcactttgggaggatgaggcaggtggatcactagaggccaggagttccagagcagcctggccaacatagggaaacccagtctctactaaaaaaatacaacaaaaattagctgggtctattaaccccagctactcaggaggctgaggcattagaatcgctggaatctgggaggtggaggttgcagtgagcggagatcatgccacagcactccaacctgggcgacagactgagactctgtctcaaaaaaataaaaataaggccaggtgccgtggctcacacctgtaatcccagcactttgggaggccaaggtgggcagatcgcttgaggtcaaggagtttgggaccagcctgggcaacacagtgaaacctcctctctactaaaaatacataaattagctgcgcatggtggcacacacttgtaatgccagctacaccagaggctgaggcaggggaatcgcttgaattcgggaggtggaggttgtagtgacctgagattgtgctactgcactccagcctggacgacagagtgagactccatctcaaaaaaaaaacaaaaaaaaagaaaatttaaatttaaaatttaaaaaaatcacaaagactacaaatactcaggtttaagcaaattcccacctttcttgaattaacagtaattcatatttgctttgtcaaaaatgtagatatttacctgccccaacggaatgaaatcctaaaagcctagtgttctcaaatgatgaagagaaagaaacatgaatattttaattaataattttgattcagaattaattttaacctagctggagtatacataatcatttatgtatttacttatttaagagactgggtttctctgtgttatccaggctggaatgcagtggcacaaccttggctcactgcaacttgtacttcctgagctcaagtgatcctcccacctcagcctccagagtagctgagactgcaagtgcatgctaccacacccagctaatttttgcggagacgagcctcactatgtttcccacactggcctttaattccttggctcactacagcctcaagcccctgggatcaagcaatctgcctcccaaagtgctgagattacaggagtgagccaccgcaccccgcctattggatagtatatactaagcaacatgtaccctgcttttgcctagaacatactgaaaacatggcattaaaaacaatcacaaaagttgggagctgagaaaaatcatatactgtaaaacaaatctgacagatattaatctcaagaagctcctgaaaatgtctcaagaactcctatgctgcactctccctaataatttagactttctacagatattttctgatcatctaccgtgtgccaggcaccatgccacgtaccaagatgccatggtgaggtatacacaaaaccggctcctgcttgtaggaagcctactctctaaaacagtgcttgccaagctcgactgatccaacttgggagcttgtttaagttccaaatcggcttccctgctttggtgagccacaatccgtggcatttttatcaggtgctcccagtgattcctacgctctaacgggtttgggaggcaagggtgggggtaagctggagagcccagagccatcccgtccagcgggagccccacctctaaagtccatgtcgctcagcatccttccccctgactagtggcccaaacacagcacgaagctgaggtgggtggaacgctttccaaaacagcgctctatgatgagccactgacagacttgctcgcctccgggaacgaagagctcactcctcacaaaccccccccccccccccccccccccgggaaaggtagcacctgagcctcccgggctgcgccgacacctggacacctgtctccccgcgggtgccacctactgctccaggggactccagtccccaggttccgccccacggggactggggggaggggggaggcgccccgcgcattaggcgccaactgtataccgacccccccctccggagtgcgcaggccagcacccatacacaccctcacacacccacacacactcccgtggaaactgaggcaggcaggcggcggaccaggtcccgccgcctgacggctcgcggctgggattgaagccggaccttccgcctcacaggcgctcctcagccgctgaggcccggcccagctcccaccgccggagtctcacaaacaaagtctcctggcccgagcccctcacgcactcacctgcgccgacgccggcggcgattcgggctccagccgccttcagctccttgcgggggcccttgggtcggctcgggcgccggcggcggcgactgctccatatccacggggtccgggcggcgtccgcctcgagttaaaggtcccgccagctaggcgcgcgcgccagttccgctcgccatgttccagccgtgctgcgcgccgccgcggcgaccctcactgccccccaaccgcgcgcgcacccgctccccgcgcgccccccctccccgcgcgccccgcctcgcgccctctggagctgaccgctgttcccagtgtctcgcccacccccgcggggcccgtccgactcgacgggtgagcccgtggttcccggctccgcaccgtcgcctgcctctctgcagaccaccccggacccgacccctcagccacttccccacgctgcccctttcgcttcccccatgacgcggggcctaggacgagggtctgggccaagaggaacttccccgcaagaagtgccgagctaaggacgctactaagggggcgggatcgccacgtggaggtgtgcaagcacgtgcctgcgtccgggagacagccagactcaacggagaagctgagttcaagtcccacatctccactaacccttgcgtgttagggtcagggcttcaggacttgtttctcctaaatctttttttttttttgagacagtctctgtcacccaggctggcggctttttgcccgccccggcttttgcccccccgccgccgcgactttttgcccgccgcggctttttgccccccccctcccccccgccgaggctttttgaccccccggccgccgcggctttttccccactgcggttttttgccccgcgccgccgcgactttttgcccgccgcggctttttgcacccccactgccgcggctttttgccccccgacgttgcggctttttgccggtcgcggcttgttgcccccctgccaccgcggctttttgccccccatcgccgcggctttttgtcccccgccgccgcggctttttgccggtcgcggcttgttgcccccctgccaccgcggctttttgccgtgcgccgccgcggctttttgacgccgcggctttttgcccccaccccccggtgccgcggttatttgcctgccgcggctttttgcccccgactgccgcggctttttgcccctcgctgccacggctttttgcccccccgcccccgctgccgcgactttttgcccgccgcggctttttgcccccccgccgccgcggctttttgcccccccgccgccgcggctttttgcccccccgccgccgcggctttttgcctccgcggctttttacccgccgcggcttttcgcccctcgctgtcgcgactttttgcaccaccccccccgccgccgcgactttttgcccaccgcggctttttgcacccccgccgccccgggtttttgcccccccccccccccgccgccgctgccatttctaggctaataaactaagaatcatgtaaactaaaccaaaatagaatagacataaaagtcctgaacacttcaacttcctatccttcacgaagtatacctcgcaaagctcatttgagagaggaaaagctttcctccaccctctgttttacagcgctgaggcttctcatcacatttctatgacttgtagcttaaatccatgttacatggtcactggcattgttaggacttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataaatctagaatttagaaagtatatttccccactggattacatttttggaaatattattttatatgtacacaaatattacaaaatcactgtagacacctgcaaactatattatcttttaaaggcaatatttatattaaactggtataacaaaattgactcaatttcattccattctgccctgattttggttatttattttcttctgctagctttgggtttgtttactcttgtttttctatttcctttaggtatgatattaggttgttaatttaagatctttctaacttttcaatatgggcctttagcacgataaatttttcacttaacactgctttgcctgtgtcttagagagcctggaatgttgtatctttgttttaattagtttcaaagaatttattggtttctgccttaatttcattgtttacccaaaagtcattcaggcacaggttgcttaatttccatgtaattgtatggttttgagagttcttcttagtgttgacttctatttttgttacactgagcagtccaagagtgtggttggcatgatttctggggtttcttttaatttattgaaaataattttagactgatagtgtgatcgattttacaatatatgccatgtacagatgagaggaagatatattctgttgttgttgggtggagtgttctgtagatggctgttaggtccatttagccaagtgttgacttcaagtcttgaatatctttgttcattttctgtctctatgatctgtctagtaccatcagtgagatgttgaagtctcccactattattctgtggttatctaagtctctctataggtctctatgaacttgttttatgaatgtgaatgctccagttttgagcacatttatctatcagacagttaactcttcttgttgaattgaaccctttatcattacttagtgcccttctttgtgtttttgattgttgttggtttaaagtctattttgtctgaattagaataacaatgcttacccttttgtgttttgcatttgcttggtagatttttttccatccttttacttcaagccaatgggtattgttgtatatgagctgggtctcttgacaacagatacagttgggctttgcttctttatccaacttgccattctgtgagttttaagcggggcatttatactgtttacattcacagttaatattggcatttatagctttggtcctgccattatgttgttagctggttattatgcagacttgattgtgtagttactttacacgtcaatggtctatgtacttaaatgtatttttgtggtggccattaacagtctttcacttccacgcttagcactcccttaaggacctcttgtaaggcatgtctggtggtaacagattcggttagcatttgtttgtctgaaaaggatcttacttctccttcacatatgaagtttagtttggctggatattaagttcttggttgaattttttttttttttttttttttttttttttttgtgacagagtcttgctctgtccccaggctggagtgcagtggtgctatcttggctcactgcaacctccacctcctgggttaagtgattctcttgcctcagcctcccgagtagctgggactacagacacgcaccaccatgcccagctaatttttgtatttttattacagatgaggtttcaccatgttggccaggatggtcttgatctcttgaccttgtgttctgcccccctcagcctcccaaagtgctgggattacaggcatgagccaccacacctggccaagtatttttttttttaaagaatgctgaaggccgggcgtgttggctcacacctgtaatcccagcactttgagaggccaaggtgggcagatcacgaggtcaggaatttgagatcaccctggccaatatggtgaaatcctgtctctattaaaattataaaaaattgccgggtgttgtggtgcacacctgtagtcccagctacttgggaggctgagggagaagaattgcttgaacccgggaagtggaggttgcagtgagccaagatatcaccagtgcactccagcctgggcaacagagtgagactccatctcgaaaaaaaaaaagaatgttgaatataggcccccggtttcttttggattgtagagtatcttatagttccactgttagcctgatgggattctctttgtatgtgacctgccccttcactttagctgcctttcatatttttttatttcatgttgaccttggagaatctgatgactgtctgtcttggggatggtcatcttgtatagtatctcacaggattctctgcatttcctggatttaaatggtgacttctctagcaagatttgggaaatttttgtgggcagtatcctcaaatatgttttccaacttgcttgttctttctccctttctttgagtgatgccctgagtcatatgtttggtctctttacataatctcagatttctcagaggttttgttcattcttttttattctttattttcatctgactgagttgattcaaagaagtggtctttgagatctgagattctttcctcagcttggtccgttctgctgttagtacttgttattgtattatgaaattcttgaggtgcatttttcagctctatcagtttcgtttggttctttcttaaaatgcctatttcatctttcagctcttatgtcatcttattggattccttaaattattaggattggattttgactttcttctgaatctcaatgatctttgtttctatccagattctgaattctatgtctgtcatttaatcttgcttaacaaccattgttggagagttagtatgattgcttgaagacaggaagacattctggctttttacattgccagagttcttgcactagttctttcacatctgtgtgggctaaggttcctttaatgttttgaatcactgtcctttggatggagttttttccttttttatattctttaatgcccttgagggtttgactgtggcacaaggtagtttcagtcaaatggcttcatttctggaagatttcagggggcaaaggctcagctcagcactcctgaactgcactttctaactttgcaaggctggtaccatacctacagatttgttgtctggcccttcaatgttaagcactgaggtgttcccagttcactggcaacaacactctgatggggtgtgccagccaaagtgcttcattgtagtgattgtaacaaggtccccactcacacatatgtgccagcagcagcagcacacagcaggtatgcatgtgttggcaggggtgcagtgccagcaggagtgggatgggggtgttctgcatacttgcacgtgccagccggggcaatggtgctgtggggtgcactcatgtgctgctggagacagagtggcagcatcttcatgagttttatgttatcattctagatctttaaaaataatattttggacttctaacaaatgtatttgtgaacccagagaaaaaaagagtattattttgtgcatttttacttaatcatacccaagaaaattttactttacaatttgttcttttcactcaacaatagtcttgaggtttatccatctcaagatagatacacatgtagttaattccttttaattgtataagattacattgtatgtcaacagcagattttatttacaacgttataacaaaaataacattttatttgtctcattttacataaatataagtttgtctagaatagttacctgggttacatgcatttttagtttgatgtatactgccaaaatcctttcggtatggccactttaatttgccctaataccaacagcttatgagcctacctgttgttcttgaaaatccttgcaaatccttgatattattaaattttataatgttttccagtctgataattgaaaaaatggcatatttttgttattttaatttgcatttctgtgattattcacaagcttgaatatcttttatatatgtgttgtccttcagcttttccttatctgtaactagcctgttcatatcctttgtccatttttttgttgagttggtcttctttattaattatatctgttatatgcatttgtaaattatatgtattgcaaatatcagtagatatttaattttgtttgtgatgattttttttcactctaagaagtgtattttgttattttcaacagacagaattgccaatacacaacactgttcacttgactttgaaaatgaaaaagagaaaaagaggaagaaagagcagaattgcttttgaagtagtactttattatagtacttttgaagttacttttgaagtgctactttaatataattgaatgtatcaaaatctctttttatgtctaatgcctttgtatgtatcattcaaaaagtcctttttacctcatgatcacaaatatattattctacatctttattttgttgttcagagtcttgctgtcacccaggctgtagtgcagtggcatgatctcagctcactgcaacctccacctcccaggttcaagtgattctcctgcctcaacctcccaagtagctgggactacaggaatgcaccactgcacccagctattggtttcgccatgttggccaggctggtctcagattcctgatctgtccacctcagcctcccaaagtgctgggattacaggtgtgagccatcatgcctagcccactacattttcttattactacttttccttttgagcttttaacatttattatgtgtaagaatctatctatattcctttccacataaatagttatctcaacaccatttgtgaaagatttctttctttctcccactgatttaaaataccagttgtatgatgtaacaaatcccatagatttgtttccacactttgtattctcttttcttccaatttattttgtctatttatatgtcactattattcagttttaactattttacctttacaaaaacagtatcttgttttcttaagtttacttgatctttcattctaagatcttattcttccaaatgaattttataatcagcttgtcaagctcagtaaaaatccctgcaaagattttgattggcgtatctctgattaattcatttgggggagagattacatctttctattattgaggctttggccgggcgtggtggctcacacctataatcccagcactttgggaggccaaggcaggcatatcacttgaggtcaggagttcaagaccagcctggccaaaatggtgaaacaccgtatctactaaaaacacgaaaactagccaggcgtggtgttgggtgatggtaaaattggggctttttagttcacacttgtgaaatgtctctctaagtattcaggtattatcttaattactatattattagattcacaatttttataaaagtatagactgtcttcacagttttgttcttagatactttgtttttttaattgatgttgtggattaaattctctttgatcacttattcctggggaagccagctgccatgtcctgaggcagccctgtggagaaaaccccgttggaaaaaaactgaagcctgcaatggctacatgagtaaacttggaagcagatcttctccaccccaccctacctcatgggaaatcttaagtcgaggcatacagctaagccatgcccagattcctgacccacagaagtcataagacaataaatatttgttgttttaagctgctatgtttggggatgacttgttaagcaaaatgagaaaaataatacaacaggtgattacaatgtgcagcagagttcaggaaccactaaactagaccagtatgtggtcttagagaagtctagtctcttcttgagcccacagggaaatctgtagcataaactgcaccatagagttgtacagccagaagcaaatctcacatcagtccgtcattggcagatctgtctggagggaaagtagaggggtgcacaacctccctagtattcccaggtaggtgcttgtcagcaggacaagggttctagaaacctgcagatattagcagccaacaagcagcactgggagatgtgttcattgacctggtaaatggattctggcaggagcaccaaaagcatttctacacaggatatacttcacgctttataaagtaaatgtagaagagatgaggtgaaattctggataagatatgccaatagaaggtattctgagcaggagcctccccattcctcatgggtgtcatcaaccactccagaaatgttctcatttgcctttgtaacttaggtggccacacttgttttttttgggcagacaactctgttccttccttccttacttacttatttactcaagaggtaggaaatgtgtggaaggtagatttgtctgatcattcttacagtggtaatccaaataatcaactatttggtttccccagaggtctctcctgctcccagcgtctgtcatttcagggcttggaccacttttagaagcacatgtatcttttgaggcaatcttatttacacacatttttgtttatggtttccttttttcaatcctaaattgtctgtctcttatctttctggcatatgcttagtttcttgtccattgatgattcaccttttgctttcttgttaggttatgaatttttctattaactttacatcttcatttcaaaggatttaggaatagagggagaggctgcaacctgtgctcagcccaacattttaaaccacgtctgtataaaattttagctagcagtaaacaatgcatgaaaagttttatcaccattaaattgcattcactcaaatttgaaattcttctaaacaatgtttgttacaaatttattataaactacttgtacttataaaacactacttgattaaaaagatgcttttaaattaattttcattctttctttcagttttgttttaggtgctgtctctcctgttgttgttgtcctttacacgatggtgttgcaagaaaatggatatggtgttgaggaagacattccaacattactaatggctgctagcagtatggatgacattctggctatcactggattcaatacatgcttgagcatagtcttctcctcgggtaaacaagaaaatataacaaccaccagatcattcatgaccttttttgtgagttctttaaacagggtttctggctttgcttcttcatgtattaaccaagactgttcaatttaacatctttttaatctccatagaaagctcattccagaccaaggaagatatttcagtggcttaagatacaactacttaacacacatgatctcactttaataatcatgtgacaattaatttgataaaccatattattactatttaactgcttctgttgcttttgaattttatcagttctcattggaaaaaattaaacagcaatattatttgtactactaatattttaataggcatttttgaaatgtgcctttttggccatcctaataaacaactggttgctctattataagacaacataaacatacagagctgggacagccatatgcctttttggtagtgttaggacaagatcctgcaccagttctgattcccaaggtgatatctggtcttgaatatcactacagaaattgtgaaactaaacatttccacatttaataatgctttaattatctgcaatgtttgagtcttctgtattattgaaatgctaaactatttttaagttgaaaagtaatatatatacttttatagtttctcttaaaataagaaaatataaataaatcagaaaaagaggaaaagttaaaaataaaatctgcaatagtcacatccagaagaaaagaatcatttccttctgaaccttttgatataaatccacccatattcccttcccttccctttttcccttcttcccttcccttcccttcccctctcctcccccttcccttcccttacccctctctctctgtcaaatattcttataaaaatcagtgaatattgaccaatatgttcttttatttttttttttttttgaggcggagtcttgctctgtcacccaggttggagtgcagtggcacaatctcggctcactgcatgctctgcctcccgggttcatgccattctcctgcctcaacctcccaagtagttgggactacaggcgcccgccaccgcgcctggctaatttttttttgtatttttagtagagccagcgtttcaccgtgttagccaggaaggtcttgatctcctgacctcgtgatccgcctgcctcggcctcccaaagtgctgggattacaggcgtgagccatcgcacccggcctaatatgttcttataacctgaattgttttacacttaactgtatatcacaaacatgtttcttttcagtaaatgtatttgtatatcatttttaatagttgtttagcttaatgaaagagtattcaatgcgctgcatcatgattacttatcctgttcaaaattaaagttaactccaatatttactattaaaataatacttagttgtgctgctataaaaatatatttttaaattaaaaaattggccgggcatggtggctcacacctataatcccagcactttgggaggccaagaagggtggatcacttgaggtcaggagttcaagaccagcctggccaacgaacatggtgaaaccccgtctccactaaaaatacaaaacttagccgggcatggtggtgggcatctgtaatcccagctactcaggaggctgaagcagaagaataacttgaacccaggaggcggaggctgtagtgagctatccagcctgggcaacagagcgagactctgtctcaaaaaaatttttttaattaaaaaaataatacttagtagaacatatagggaaatatttgtacctaatcttcatattttcttaagcttaaaagtgtaattgttgatctaaaaggtatatacatttatgagtgttctgaaacatattgccacaatatcatgtcctaccagggtacataaacttgtcatttcctctcacctctcttcaaaacttggtattactagcctttttcatctttgctaatttgataggtgaaggagggatctctataaatgaagtactttgaatactagtgttgttaaatatccatgtttattagtcattggcattttgtaaattgcttttcttgaaagttttttgcctatttcttttaggtgggttcaccttttgttctttttgatttgtcaagattctgcattaaattgagaatgaaaacctttgttttatatactttagttttttcaatttgtaatttggcttttaattttctcactctttttaccattcagaagttaaagttttttattgtcaattgtgaaaatcttttccttcatgattggtatctgtcattctttcaaaaaatattcttatcagtcatgtttcaaaaaaatatttccaggctgggcccaatggctcacgcctataatcccaacactttgggaggccaaagcggggggatcacttgaggacatgagttcaagaccagcctggccaacatagcaaagctccatctctactaaaaatacaaaacgttagctgggtgtggtggcacaggcctgtaatcccagctactcagggggctgaggcacaagaatcacttgaacccaagaagcagaggttgcagtgagccaagatcacaccactgcactccagcctgggtgacagagggagactgtctgaaaaaaagaaaaaaaaaaattcctcttccttttgccggctactatgccaaacactgagaataaacagtaggcaacaacattagcttttattgaatacttacttggctcttgttctaagttccatatatgtcaccactcatttacaggtaaggaaactgagaaagatgttaagtaattttctccaggacagagatccaataagtaggggagccgagatgcaaatctgacagtctttcactccatacccacacatttaactcttctcttctccactgcctcccaacacaacagagagacaagatcaaatggtgcatgttctcaaggagcttgtatattaaagaaaaattacaaatgggatgaatattacattgtgaaggttaatattcagtaaggtgtcaacttgattggattgaaggatccaaagtattgttcccggttgtttctgtgagggtgttgtcaaaggagattaacatttatttagtggactgggaaaggcagatccaccctcaatgtgggtgggcaccatacaatcagctgccagcatggctagaataaagcaggcagaaggaggttagtagaagctgacttgctgagccttctgccctcatctttctcccatgctggatgcttcctgcactcaaatgtcagactccaggttctttggcttttggactcttggacttactccagttgttttccaggggctctcaggccttcatccagagactcaaagctggcctgtcggtttccctacttttgaggtgttgggactcggactgagccaatattagattccttgctcctcaacttgcagacggcctgttgtaggacttcaattgtgatggtgtgaatcaattctccttaataaactccctttcatatatatatatatatatatatatatatatatatatatatatatatatatatatatatatatcctattagttctatccctctagagaaccatgactaatacagattctgatactgaggtaatggaatattgctataagatacctgagaatgtggaagtgactttggaactgtgtaatgtgcagagtttggaacagttgggaggactcagaagaagaccagaagatgtgggaaagtttggaactgcctagagacttgttgaatggctttgaccaaactgctgatagtgacttggacagtgaagtccaggctgaggaggtccgagatggagatgaacaacttgttgggaactgaaataaaggtcactcttgctatgctttagcaaagagactggtggcattttgcccctgccctacagatttatggaactttgaaattgagagagatgactgaggacatctggtagaagaaacgtttgttgttgttgttgttgttataccttaagttctagggtacatatgcacaacgtgcaggtttgatacataggtatacatgtgccatgttggtttgctgcacccatcaactcatcatttacattaggtatttctcctaatgctctccctcccccagccctccaccccccaacaagccccagtgtgtgatgttcccagccctgtgtccaagtgatctcattgttcaattcccatctataagtgagaacatgtggtgtttggttttctgtccttgtgatagttttgctgagaatgatggtttccagcttcatttatctccctgcaaaggacatgaactcatccttttttatggctgcatagtattccatggtgtatatgtgccacattttcttaatccagtctatcattgttggacatttgggttggttccaagtgtttgctattgttaatagtgccgcaataaacatacatgtgcatgtgtctttatagtagcatgatttataatcctttgggtatatacccagtaatgggattgctgggtcaaatggtaattctagttctagatcctcgaggaatcaccacaatgtctttcacaatggttgaactagtttacactcccaccaacagtgtaaaagcgttcctatttctccatatcctctccagcacctgttgtttcctgactttttaatgaatgccattctaactggggtgagatggtatctcattgtggttttgatttgcatttctctgatgaccagtgatggtgagctttttttcttgtgtctgttagctgcatagatgtcttctttggagaagtgtctattcatatctttgcccactttttgatggggttgtttttttcttgtaaatttgtttgaattctttctttgtcaaatgggtagattgcaatttatctcccattctgtatgttgcctggttcactctgatggcagtttcttttgccgtgcagaagctctttagtttaattagatcccatttgtcaattttggctttcgttgccattgcttttggtgttttagtcatgaagtccttgctcatgcctatggcctgaatggtattgcctaggttttcttctagggtttttatggttttaggtctaacatttaagtctttaatccaccttgaattaatttttgtataagatgtaaggaagggatccagtttcagctttctacatatagctagccagttttcccagcgtcatttattaaataggcagtcctttccccatttcttgtttttgtcaggtttgtcaaagatcagatggctgtagatgtgtggtcttatttctgaggcctctgttctgttccattggtctatatatctgttttggcaccagtaccatgctgttttggttactgtagccttgtagtatagtttgaagtcaggtagtgtgatgcctccagatttgttctttttgcttaggattgtcttggcaatgcaggctcttttttggttccatatgaactttaaagtagttttttccaattctgtgaagaaatttattagtagcttgatggggatggtattgaatctataaattactttgtgccgtatgtccattttcatgatattgattcttcctatccatgagcgtggaatattcttccatttgtttgtgtcctcttttaattcgttgagcagtggtttgtagttctccttgaagaggtccttcacaacccttgtaagtcagattcctaggtattttattctctttgtagcaattgtgaatgggagttcactcatgatttggctctctgtctattaatggtgtataggaatgcttgtgatttttgcacattaattttgtatcctgagagtttgctgaagttgcttatcagcttaaggagattttgggctgagatgatggggttttctaaatatacaatcatgtcatctgcaaacagggacaatttgacttcatcttttcctaactgaataccatttatttctttctcctgcctgattccactggtcagaacttccaacaccatgttgaataagagtggtgagagagggcatccttgtcttgtgccggttttcaaaaggaatgcttccagtttttgcccattcagtatgatattggctgtgggtttgtcataaatagctcttattattttgagatacgtcccatcagtatctagtttattgagagttgttagcatgaaggagtgttgaattttgtcaaaggtcttttctgcatctcttgagataatcatgtggtttttgtctttggttctgtttatgtaatggattacgtttattgatttgcatatgttgaaccagccttgcatcccagggatgaagcccacttgatcgtggtggataagctttttgatgtgctgctggatttggtttgccaatattttattgaggatttttgcatcgatgttcatcaaggatattggtctaaaattctctttttttgttgtgtctctgccaggctttggtaccaggatgatgttggcctcataaaatgagttagggaggattccctattgttctttttttttggatgaaaaaagaactgtttaatttttttgatgttttcaatgttgatatgttttccaagaattagagaaatatctctggatggttatctaaaatttataatttttctacagatatggtatgtaggagagtgtcatagtttttctattattatactttaagttctagggtacatgtgcacaatgtgctggtttgttacatatgtatacatgtgtcatgttggtgtgctgcacccattaactagtcatttacattagatatatctcctaatgctatcccccctccccccactccatgacaggccccagtgtgtgatgttccccaccctgtgtccaagtgttctcattgttcaattcccacctatgagtgagaacatgtggtgtttagttttctgtccttgtgatagttttctcagaatgatggtttctagcttcatccatgtccttacaaaggacatgaactcatcctttttatggctgcatagtattccatggtgtatatgtgccgcattttcttaatccagtctatcattgatggacatttaggttggttccaagtctttgctattgtgaatagtgccgcaataaacatacgtgtgcatgtgtctttatagcagcacgattcacaatcctttgggtatatgcccagtaatgggatggctgggtgaaatggtatttctagttctagatctttgaggaattgccacactgtcttctacaatgattgaactagtttacactcccaccaacagtgtaaaagccttcctatttctccatatcctctccagcacatgttgtttcctgactttttaatgatcgccattctaattggtgtgagatggtatctcattgtggttttgatttgcatttctctgatggccagtgatgatgagcatttttccagtgtctgttggcttcatagatgtcttcttttgagaagtgtctgttcataccctttgcccactttttgatggggtagtttgattttttcatataaatttgtttaagttctttgtagattctggatattagccctttgtcagatgggtagattgtaaaaattttctcccattctgtaggttgtctgttcactctgatggtagtttcttttgctatgcagaagctcttgaatttaattggatctcatttgtcaattttggcttttgttgccattgctattggtgttttagtcatgaattccttgcccatgcctatgtcctgaatggtattgtctaggtattcttctaggatttttatggttttaggtctaacatttaagtctttaatccatcttgaattaatttttatataagttgtaaggaagggatctagtttcagctttccacatatggctagccagttctcccagcaccatttattaaatagggaatcctttccccatttcttgtttatgtcaggtttgtcaaagatcagatggttgtagatgtgtggtattatttctgagggctctattctgttccattggtctgtatctctgttttggcaccagtaccatgctgttttggttactgtagccttgtagtgtagtttgaagtcaggtagtgtgatgcctccagatttgttctttttgcttaggattgacttggcaatgcaggttcttttttggttccatatgaactttaaagttgttttttccaattctgtgaagaaagtcatttgtagcttgatggggatggcattgaatctataaattatctttggctgtatggccattttcacgatattgattcttcctatccatgagcatggaatgttcttccatttgtttgtgtcctcttttattttgttgagcagcgatttgtagttctccttgaagaggcccttcacgtcccttgtaagttggattcctaggtattttattctctttgaagcaattgtgaatggaagttcactcatgatttggctctctgtttgtctgttattggtgtataggaatgcttgtgatttttgcacattgattttgtatccagagactttgctgaagttgcttatcagcttaaggagattttgagctgagatgatggggttttgtgaatatacagtcatgtcatcttcagacagggacaatttgacttcctcttttcctaactgaataccctttatttcattctcttgcctgatttccctggccagaacttccaagactattttgaataggagtggtgagagagagaatcgttgtcttgtgccaggtttcaaagggaatgcttccagttattgtccattcagtatgatattggctgtgtgtttgtcataaatagctctcattattttgagatacgtcccatcagtacctcgtttattgagagttcttagcatgaagggctgttgaattttgtcaaaggtcttttctgcatctattaagataatcatgtggtttttgtctttggttctgtttataggatgtattacgtttattgatttgcgtatgttgaaccagtcttgcatcctagggatgccaacttgatcatggtggataagctttttgatgtgctgctggattcagtttgttagtatcttattgaggatatttgcatcaatgttcatcagggatattggtctaaaattctcttttttgttgttggtgtgtctctgtcaggctttggtatcaggatgatgttggcctcattaaatgaattagggaggattctatctttttctattgattggaaaagtttcagaaagactggtaccagctcctctttgtacctctggtagaactcagctgtgaatccatctggtcctggacttttttttggttggtaggctattaattattgcctcaagttcagagcctgttattggtctattcagatattcaacttcttcctggtttagtcttgcaagggtgtatgtgtcccagaatttatccatttcttctagatgttcaagtttatttgtgtataggtgtttatagtattctctgatggtagtttttacttccctgggctcagtggtgatatcccctttatcatttttattgcatctatttgattcctctctctttccttctttattagtcttgctagcagtctatcaattttgttgatcttttcaaaaaaccagctcctggattcattgcttttttgaagggattttgtgtctctgtctccttcagctctgctctgatcttattttttccttctgccagcttttgaatgtgtttgctcttgcttctctagttcttttaattgtcatgttagggggtcaattttagatctttcctgctttctcttctgggcatttagtgctatcaatttccccctacacactgctttaaatgtgtcccagagattctggtacattgtgtctttgttttcattggtttcaaagaacatctttatttctgccttcattttgttatttacccagtagtcattcaggagcaaattgttcagtttccatgtagttgttcagttttgagtgagcttcttaatcctaagttcgaatttgattgcactgtggtctgagagacagtttgttgtgatttctgttcttttacatttggtgaggagtgctttacttccaattatgtggtcaaatttagaataagtgatatgtggtgctgagaataatgtatactctgttgatttgaggtggagatttctgtggatgtctattgggtctgtttgttgcagagctgagttcaggtcctggatatctttgttaaccttctgccttgttgatctttctaatattgacagttcggtgttaaagtctcccattattattgtgtgggagtctaagtctctttgtaggtctctaaggacttgctttatgaatctgggtgctcttgtattgggtgcatatatatttaggatagttagctcttcttgttgcattgatccctttaccattatgtaatggcctttgtctccattgatctttgttggtttaaagtctgttttatcagagacaaggattgcaacccctgcctttttttgttttccattttcttggtagatcttcctccatccctttatgttgaacctatgtgtgaatttgcgcatgagatgggtctcctgaatacagcacactgatgggtcttgactctttatccaatttgccagtctgtgtcctttaattggggcatttagcccatttatgtttacagttaatattgtaatgtgtgaatttgatcctgtcattatgatattcgctgttatttgcccgttaattgatgcagtttcttcctagcattgatgttctctataacttggcatgtttttgcactggctggtaccgggtgtttctttccatgtttagtgcttccttcaggagctcttgtaaggcaggcctggtggtgacaaaatctctcagcatttgcttgtcagtaaagaattttattttctccttcacttatgaagcttagtttggctggatatgaaactctggattgaaaattattttctttaagaatgttgaatattggcccccactctcttctggattgtagggtttctgccaagagatcagctgttagtctgatgggcttccctttgtggctaacctgacctttctctctggctgcccttaacactttttcctacacttcaaccttggtgaatctgacaattatgtgtcttggaatcgctcttctcagagagtatctttgtgttgttctctgtatttcctgaagttgaatgttggcctgccttgctaggttggggaagttctcctggataatatcctgcagactgttttccaacttggttccattctccttatcactttccggtacaccaatcaaatatagatttggtcttttcacatggtcccatatttcttggaggctttcttcatttctttttactcttgtttctctaaccttgtcttctcactttatttcatttatttgatcttcaatcactgataccctttcttccacttgattgaatcggctattgaagcttgtgcatgtgtcacaaagttctcgtgccatggttttcagctccattgggtcacttaaggtcttctctacactgtttattcttgtaagccattcgtctaatcttttttcaaggtttttagcttccttgcaatgggttccaacatcctcctttagctcggagaagtttgttattaccaaccttctgaagcctacttctgtcaactcgtcaaagtcattctacgtccagctttgttccattgctgacaaggagctgtgatcctttggaggagaaggggtgctctgatttttagaattttcagcttttctgctctggtttatccccatccttttggttttatctacctttggtctttgatattgttgatctacagatggggttttggttagatgatcttttgttaatgttgacactattcctttctgttttttagttttccttctaacagtcaggaccctcagctgcagatctgttggagtttgctggagttccactccagacactgtttgcctgggtatcaccagtggaggctgcagaacagcaaatattgcagaacagcaaatattgctgcctgatccttcctctggaagctttgtccaagaggggcagccgcctatatgaggtgtctgtcagcccctactgggaggtgtgtcccagttaggctacacaggggtcagggacccacttgaggaggcagtctgtccattctcagaactcaaacgccatgctgggaaaaccactgctctcttcagagctgtcagacagggacgtttaagtctgcagaagttgctgccttttgttcagctatccctgcccacagacgtggagtctagaggcaatgggccttgttgagctgcggtgggctccaccgagttcaagcttccctggccactttgtttacctacttaagcctcagcaatgatggacgcccctcccccagccaggctgccacctcacagatggatttcagactgttgtgctagcagtgagcaaggctccatgggtgtgggacccactgagccaggcacaggagagaatcaccttgtctgctagttgctaagaccttgggaaaagtgcagtatttgggcgggagtgccctgtttttccaggtagtctgtcacagcttcccttggctaggaaagggaaatcccccaaccccttgtgcttcccgggtgaggcgacaccccaccctgcttcagctcaccctctgtgggcctgcacccactctccaaccagtcccaatgagatgaaccaggtacctcagttggaagtgcagaaatcacctgtcttctgtgtcgatcatgctgggagctgcagaccggaactgttcctattttgccatcttggaatccatccaggacatctggtagaagaaatttgtaagcagcaaagtgttcaatttatgacctgagtgctcttaaaagtgttcagttttatgtgttcacaaaaatatggtttggaattagaacttatgtttaaaagggagcagagcatgaaagtttggaagatttgcagcctgatgatgtgatagaaaagaaaacccattttctggggagaaattcaagctgactgcagaaatttgcagaagtaacaaggagccaaatgttaattgacaagataatggggaaattgtctccagggcatgtcagagttcttcacgacagcccctcccatcacagggttggaggcctaggagggaaaaaatggttttgtgggccaggcccagaactttgctgctctgtgcagtcttgggacttggtgccctgtgtcccagccatggctaaaaggagccaatgtgcagctcaggctattgcttcagagttcaatccccaagccttggcagtttccatgtagtgttgggttgatatgctagttggccatttgtatttctttttggaaaaaatgtctattcaagtctatcttagtccattcctgctgctataacaaaataccttaggctggtaatttataaacaacagaaatttatttcttgcattctggagtgtgagaagtccaagatttaggctacgacagactcagtgactggtgaggtcactatattcactatatatagcaccttctctgtgtcctcaaatgttcaaaagggaaaacaaactcccttaagcctcttttataaaggccctagtcccatttctgagagctatgacttcatgaactaatcatctccaaaatgccccacctcttaatattatcacattgaatattaggctccagcatatgaatattgggagaacatttggaccatagcaaagtcaactgaccatttctcatttaggttgttttgttattgagttgttgttctgtatatattttagatattaaccccttatcaggtatttggtttgctgggaggtttttgattcctgattcagttactagttataggtttattaagattttttattttgtgacttagtcttggtaacttgcatgttacaaggaatctgttcatttctcctaggttatccaacttgtcagtatataatcattcatagtagactcttagaatcctttttatttctgtaatatctgttgcagtgtcttctcttttgttcctaaaagaagttgagtcttctttttttttcttaaatattctagctaatgatttgtcaattttgttgaactttgaaacaactactagtttcattggattttttctattctctagccttttttttttttttttttttttgagatggagttttgctcttattgcccaggctgtagtgcaatggcgtgatctccgctcgctgcaacctccacctcccagttcaagtgactctcctgcctcagcctccagagtagctgggattacaggcatgaaccaccatgcccggctaattttgtattttttagtagagacacgtttctccatgttgctgaggctggtctcgaactcccgacttcaggtgatccacctgcctcggcctcccaaagtgctgggattacagtcgtgagccactgctcccggccttctgctctagactttattatttccttcctgttgctaacattgggttgagttcttctttttccagtttcttgaggtgtaaagctaagttgctgattttagatctttcttcttttttaaggtaggtagttagatatataaactgtcctcttcatattcattttgctgcatcccacaagctttggaatgttgtgtttccatttttatttgtctcaagacattttctaattttccttgtgacttattctttgactatgtattaatcagagttctcaagagggtcagatccaataggaaatatagatatagatacagatatggatgatatagatatatatatagataatagatatagatataaatatatacacatgcatctaaaagagaatatatttacatatatatgaaatataatttattaaggagatttggctcacataattacaaaggcaaagtcccacaataggccatctataagctggaaaatgagagaagcctacagcatggctcccaaggaagccagtgacatggctcagtcccagtctgaaagtctcaaaaccagggaggctgacagtgcagccactagtctgaggaccaaggcctgagagctcccaaaaggctgctgatgcaagtcccagggtccaaaggccaaagaacctagagtttgatgtgcaagggcaagaggaaaaaaaggcatactgctctggaagagagagaaagtgcataaaaaagaaatccaagcaagctgaatgttcccattcttctgcctttttgttctagtcacacttgcaaccaattgcatgatgcctacccacagtgaggatgggtttttctctctcagtccactaactcatccatcattctcctgtggcagcaccctcacagatatacacacacacagtgcttcatcaggcatctaagcatccctcaatcaaattgtcaattaatattaaccacacaggtcaattggttaagagagtatatttttgtaatttccacatatttattacttttcctttttccttctgctatgaatttgtaatttcatttaatgtggtcagaaaagatatttggtatgagttcagttttcttaaatttttaaaaacttgtttgtggactagcatgtcatctatcctggaatcgtcttggtatgtacttgagaagaaagtgtattttgctattattgggtgaagtgttctgtatatgtcagacaggtccaattggtctataatgttgttcaagttctgtgttttccagttgatcttctgtctggttattgtatccataattgaaagtggaatattgaagttttctgttattatgatgttgctatctatgttacccctcaattctgtctatgttagcttcatatatttagatgctgtactgttagttacatatacatttataattgctatatcttcttggtcaattggcccttttattattatgtaatatccttgtctgttgtgctattatttgaattaaactctattttgtctaagtatggccatccttgttctcttttggttaccaaatgcattgaatatctttttccatcctttcactttcaacctttgtgtgtgtttagatctaacataagtctcttgcatatagtatatatttacatttttttaatccattcagccaattctctgtcttttgattggaaaattagcctatttgcatttaaagtagttactgatagggaggggcttactattgtcattttgttcattgttttatacatgtcttgcaggtatttttttccacttttcctctctttctgcctccctttatgtttcactgattcctttttttggtagggacgtgctttggttcctttctcatttttatttgtgtaacttctgtaggtcttttctttgtggttactgtagaattacatgaaaacatcttatagttataataatctattttaaattgacaacaacttaactttaatcacatacaaaaactctacttctttacacctccttctcactttgttatcaatgtcacactatatattttatattgtttattcacataatttaatacagtaatattatgctttcaacttttaaattctatgcatcaattaaaagtgaattacaggctgggtgtggtgtctcccacctgtagacccagcactttgacaggccaaaatgggaggatcgcttgagcctaggagtttgagaccagcaaggccttatgtctgctaaaaatttaaaaatattatctgagtgtggtggtgcatgtctgtagtcccagccactcgggaggctgaggtgggaggattgctttagcccaggactacaaggctgcagtgagccatgatcaaaccactgcactccagcctgggcaacagagcaagacttcgtctcaaaaaaaaaaaaaagtaaaggaaaaaaagtgttttgcttaccaccattagagtattaaaagattctatgttcactcatatatttacctttaccaaagaagtttatattttgtatgcttttgtatttctatccaatgccttttcatttccacttggaggactccctttaacattttttgtaaggtaggtctagtggtgatcaactccctcaccttttacttctctggggaactcttcgtttgtccttcatttttgaagtagagttttactggctatacagttcttgttgacagttttttttttctttcagcccttttaatatatcatcccattctcttctggtctgtagagtttttgctgataattccattgataaccatatggcatctcccttgtatgtgacaagttgctttggtcctgttcctttcaaaattctctctttgtctttgacttttgacagtttgattgtaatgtgtctcattgtaggtcttttgcaaattatccaacttggagttctttgagcctcttggatttgtatgtccatttccttctttaagtttgagaagtttttggtcattatttttttaactggctctctgcccctttatttttctctcctccgggcactttcataatgcatacattggtctgcttgatggcatcctgtaagtctcttaggctgtcttcactcttcactccttttcccttttgctcttctgactccataatttcaaatgactagtcttccgtttcactgattctttcttctgcttgatgttattgaaactgcctttgcaaaaattataactgaagaaattatgacagcaaaagacatcagacttaatcaactccatcttgcttctagcatttaaactgtccttgttcattcctggcagtaggatgaactaattttgggaaggtattcagttcatggtttgactctgaaacaaagttgataatagccatttcccaaaaagatccccttcttgcctggaaccagtctgcctttgcaggataaacaaattagctataacatcagaaattacagttgaggggttatgcagcctctggctccaagagtctgaacctctccaaattgctcctggggataacatcactattgtaaaacctaaaatcagtgcttgagatattttgcggaccctgcactggatgaatcagctgacaccacccagactggtaatatggctcaactagttctgccaccccacccacaaacagaagacagcaagaaaacatcatttcaaccctgtatgatttcatctccaacctgatgaataggcagtccccactttccaagcccctacctgccaaattatctttaaaagttctgatccccgaatgctcagggagactgatttgagtaataataaaactctgatctcccgcacagctggctctgcctgaattactctttctccattgcagttcccctgtcttgataaatcagctctgtctaagcagggcacgaggtgaaaccactgggcagttacacagtctattggtgatttccaatagtgaatttttcaattgagctattgtattccttagctccagagtttctgtatggttccttttttttttttttagtttctatctccattaatattttcattttcttcatgaattatttcctgctttcacttagttgtctatttctgttgtcactgggcttcattaagagagttaatttggattctttgtcaggtaactcatttatctatttctttagggttggtttctgtagatttattttgctcctttaatttagtcatcaggtttctctgtttcttcttatgtcttgttattttttatttttttatttatttttgccaagatttgggcgtttgaaaaaactgccacttctcccagtttttatcagctggcttcatacggaagaccttcatacctgaatcagcatggctataggttccagcagcctctcaaactttttctgggaatgcatcttgtttgggtttatacattgcaacatcccaagtagaggtttgccagtttctttttctggagctgttgctccctctggtatctgtctgtggtactgcaggttccctggtgctgcatcatctctgacctctcctttattcccagtggctcccatgaatccaaagtatgccagttgggcgtcaagttagagagagagggagagcttcaggtaacctcataaaactattccgttccagtcttctctttctctgctaacggagaagctgcaagttgagtgcttcccagccaaaccaacctgttcgagcttggggaaggggtatcatgagtataatgcaacagcttttcttatttgttcaatgccactattcttggttttgcacttgtctgtgctactacaatttcttaatggtttatggaactccataaaggcttttagaccatatattgtttttcagttgctatctttatggagaatcaaggtttggagccattccaccatctggctggcatcactctgtttatataattttttatttttattatattttattttcttgagacaggatcttgctctgtcagccaggctagagtgcagcctcgaactcctgagctcaagggacctcctccctcaggctactgagtacttggactataggtacacaccacataccgggctaatttcctattttcttgtgaagatggggtttcactctgttgcccaaattggtctcaaatcttgggctcaagcaatctttctgccttggcctcccaaagtgctaggattaaaggtgtgagcccaccatgcgctgcctgttatatttagtagaaaatatatctaaaaatatacttacgtactatattgaatccactacccagagcttaactgaactatttttgtgactcattctggttttttttattttttgctttttacttattacaatgaactacaagtatggatatattaatattaattaatataaaatatactggaatcttttgtattttttttccttttttcttcaccaaaagcagaaacttaaatatactgaaatcttaaatgacccttgaatgtttctaggactgaccctggaacaaaattttttatgttgttattacattgttcttttcatgttaaaatcatttgtttctttttcatatagtacatcaaagaagaattgttaatatagcccttaccagccatatgctaagtgccacaagtgtttcggtctctctccattcttgtacctcacttggtcttttttttcttttcgaggtgtagcctccatctttcacccaggctggagtgtggtggcacgatctcagctcactgcaacctctgcctcccaggttcaagtgattctcctccctcagcctcctgagtacctgggaccacagttgtgtgccaccatgcccacaaaatttttgtatttttagtagagatggggcttcattatgttggccaggctggtcttgaactcctgacctcaagtaattcaccctcctcggcctcccaaagcgctaggattacagacatgaaccactgtgcccggactacctcactctgtcttttaaattggctatgtaaggggagcatcttgtgcttaagtctttgttttctggcctatttatataatggacatttctgagttgtgtgtatatattaaattatttgagagtatatatttaatgtactaaatagatctacgtgttttcatacatgtcactataaaaagaccatttgcatatatttgttctataaaatgcttacttttcttcatgaaccacctagatttgcttttctgatgtgtagtgtatgtgaaaatatttctttgtgaatttttttttattgtgtgcccctacaggtggtatgcttaataacgccatagcctctataaggaacatatgtattagtcggctggcaggaattgttttgggattttttgttcgatattttccaagtgaagaccagttaaatacaaaatctatcttatagaagtatagtattagacttttttttcaaaatattaaactttggtaagatccatgaaatttaatacttaactctatttttctaaaactagcctccaatgcctactctgtatttaaaactgagcacagtggtgattgatacaggtcaatggctttgattaaagtctctgcttcctgatttggcaaataaggaatgtcaaaaaatatacttaattcagagtatccctctcaattatactttccctttctctactaaattgcctattgaggtttgataatttcccccaaattttcccttaaacattttagggggagataggttcccatttatttctgcatattttctgactgaaattcactcctgctatcctttgacaaaggcaacactcaaacttagccatttcctgccttaaaggaaaacatgccattacttttgtatttctgtaatttccatccaaatttagctgtaacatattgaccaaagagatattcaaatattttttaagaattcattggatatgttatatgaaactggagattttatgggtctcttttcttcttcacttaaagtaatattttaactattttactgatactagtatcagagatgtggcagaagatgaaacgttactaattggaaattttgttacttggtagtaagtctgctaaaatgtatggtgagaaagaaaatcaaaattttagacatgtaatataacatttaaagacataatatcaaagggtcaaacatatataatagataatgtctgtctgggcgacagagcaacactcaatctcaaaaaaaaaataaataaataaacaaaaacaaacaaagaaactcaatgtaacctttttctatttttatttttattttcattttgagaccaggtctcactctgtcacccaaactggagtgcagtggcatgatcacggctcactgcagcctcaaccacctgggctcaaacaatcctctcacatcaacctcctgagtagctaggatcacagtcacctgccaccacacccaactgctttttttcagttttttttttttttttttgagacagtcttactctgttgcccaggctggagtgcagtggcatgatctcagctcaatgcaacctccacctcccaggttcaagcgattctcctgcctcagcctcctcagtagctgggattacaggtgcacaccaccacacccagctaatttttgtatttttggtagatatggggtctcaccatgttggccaggctagtctcaaactcctgacctcaagtgatctgcccgcctcagcctcccaaagtgctgggattacaggcatgagccactgtgcctggccttttctttctgatttttttgtaaagaggaggtcttgctatgttgcccaggctgatcttgaactcctaggttcaagtgatcttcctgcctcagcctcctaaagttctgggattacaggcataacccactgggcacagccaacgtaaccttttgaaatctcagttttaaaagcaattattttgaaatcaaaaagtattctttcaataagtactttctaagtttatgaaaatatgttttttattttcctaaaatatataataagaatatatctgaaaattggagtttttatattttgctgaatataacaaagctaaatgttatgattttaaaaagtagagacacaggccaggcatggtggctcatgcctgtaatcctcgcacttcgggaggctgaggcaggcagatcacttgacctcaggagttcaagaccagcctgggcaacatggtaaaacccctgtctctacaaaaaaaatacaaaaaaattagtcaggtgtggtggcacgcacctgtagtcacagctacttggggactgaggcaggagaatagcttgaactcgggaggttgaggctgcagtgagctgaggtcacgccacttcactccagcttgggtgacaaagtgagaccctgtcgcaaaaaaaagtaaagtaaaatagagacacattgattttttaaaaaatacttttcctaccttgccactcactccatcacacaaatgtgcatatatttttttaattacacatttatttgtatactatttggttaatggctaaatccctgcccccgcccccttgatagactacgtaaggacagggacagtgtctagtcgttgcagttgtttttcattatttctccctggcacttaacacagtgcctgacatgcaggaggcaaatacgtattgcatgcctgcaaggatgaatgaacggaaagggaaaccttgtaattttgccctgttattcaaggagattctcctcctactaaaatatattgctacttcttgttagactgtttaacttggcagcataatataccttaatttcctgtggctcttttcttagttgttattccaaaacagaagctcctaaattttcatgcaaaaaacctctattatcatgttagaaaagcaggctcatagggccagactacctgttttgaataccatgttacttgcctataacctcaggaaaattattttctagtctctcagtccttcagtgttctcgtcttgcaatgaagtctatgactgtatctgtttcttagcagtattgtcaggattcaaggagataatccacgtaaagtgccttagcactctctctggcatatggtggtgctcagttaacaaacaatgttgttattttatcttaccttcaagtaatataaataataactttttatttttaatgtctactgtagggaataataaatctacaaaaggagtatctgttctctctccttccaacaatactcttgcaattttgtttcattatttcataattttcataaagcagggaaaaaagaaaagcaggtatgaggaaagagaccactcactcgagccctgcagtattattctgcttctgcctattcctgtcggctggctccaggctggcttctacacaaagaatatcaagctggtcccaggaactggcaagacataaaaaattaattatttatacaagtagagtcacaacagcaataatagataacaataatgtcacaagtaaatacgatcaacaaatatttaaatttcaattttaaattattttcacctttatcctcttccgccattctctgctgctaaaataaaattggctaaggttcagctttctcttgttccttagtttcgagttactgataaaagttagacaggaaaaatagaagctattaggagagtaaataaataatttagtttacaaatgtaagatcagcttggcaactggatttttttaaagaaatagtattaaatctcagtcactaggaggaaatcatttatcatctaataaaagtcctcacataataaggttgtcataagaattaaatgaattgataaatggaaagctttaagaatgatacctgacatatgatgaatgccatataactataaaaatattatttctagtttcaccattatcgtcatcatctcttaaaagtcagtgggtttggcttttgtttttgttttttctgttggcagttcttttatgttcaaatcctcttctaaactgtgagattctttcaacgtggttttctgcatgattattttttttctccctagcatcctccagcacactggatcatgttcagtacattaaaagttatgatataaaaataataccattttaaattattgatttaggatatagaaattgatcttaaattgaggggttctcttgccataatgttccatatcagaggtaatgtttctactattatgttgttacttcacaactccatagaaaatatgttatatgttggtatttaattcccccaaattttaaggcaatttcaggcctagttattaaacacaaggaaagatagttacaagaaatttgctttatgttattaaaaataatatggtagaaggtaactagggaaaaatcttgtgacccagtagtcattctaaaaaaaaacttcaaaggaactcattctctgacctggcaggggatgaggagtgaaggagaaagaaacttactactatctgaatacctactgtgtgccaggtattcttcacattctcatatttaattttcacaaccgtccagtaagataagtattttgttcttcgttttacacgtaagtaagtagaagtttagagagtgtgagtcatttgtacaaggtcactagcctggttgcagcaaaaatagaattcaaacccagtttgctagattccaaacctgctgtcagttctgctataacccagtgccccctgaataaggagaacaatgagaagaagggcaacacatcctagagaaccataagaaaacttaatattttatttggtcttcttgtagtcaaaaactactggtacacgataaaggcaactaagcaaaactggttttgttagaactcctggtgttatgagggcaacactcaaaagagatatttgaatagaggaacactgagaggacaagagtgcaaaatcagcccaaaaatgtttgcatgctgatttgtcactattgtactcttcctccacatatatttgctaggaagaacatggaactgatgagtaacttatgataattactgagtacttttttttttctaatagtctagtactagattttgtttattttaacagggccatttacattatatattaactcagtaatatttttctttatgccccatttttatccctaaatgtaggctgtgctaggtcctctggctctagaaacagcaagagtctccgcaccccacttggaaccatatgcgaaggatgtgatgacagtagcatttttagccatctcgatcacagctccaaatggagctctacttatgggcattctggggcctaaaatgcttacacaccattatgatccaagcaaaataaaactgcaattgtcaacattagaacatcattaaaaagtttacctgtcatcatctgcctgcttcttttaatgaattatttcacatgactgaagaattttaaagtagaaatatgtaggaactgcacagaaaatccaggatttagtaaacatgtgatttcagtacagggcttttcttggactttttactccaaagttaatttaataaaaataatattaaatggaatgctctcttggtatttacatactgtaagaacaaattaaatctgtaaataccctaggaaagtttaagtaatccctcaggctgaatttgatatcataatacaaactgagcttaatataaaattaaacaaacttaatggcagaaagaaaaactttgaatattgaacttggtaagatagcctaagtttccaaataggaggagtagaactccccatgatatccagtaattccgttaaaaagatcactacaaaaaaaaaaggagtaaaacacatcaactttaaatgggttaactgaatagattttaaattctggttttggtgactacctgaataaataatatgttaagtaatagaaccaagttagtctttccttatttctgccatgcccttaaaatgaaagtctggtttagcagtttttagatgaaacactatctatatatttatttatagaaataaaattaaatcacaaatggaagtaaactatatttttttcaattagtgttttaaaatctaggcataaaaggcagcctccaaaaatgaaagatttggagactactgtcatgtggcagtttcttctccttagtaatatagaattatcttttaattctggctgattaaatctgccatgttaatgtagaacccatcacaagcaaagtgagttttaattaacttcaagactctttattttaaagttataagagttatataagcacttctaaaatggccttattgaaaggcattttagaaattgtttagacttctttggcaaaagctcaatgcaaggactgaatattactttcattcctctttttcctcttctccacaagcaagatattaaaatgccacagaatatgaaattcacacacaaatttgccaagtgaagcaattaaaatttaaggcaatcaaaactatgtgttattcctattaagactaagggcttttatagaatatatcaccgaaactgccaaaagttctaaaaccatctgggaaataactcttagaaaatacactctgggagaataactctgggaaaagataaaatagctactgttttagtgatattttctctttatagttttacaacaaagtacagactccattttcaaatattgtaattctagtactcaaattctaaaaatttaaactgtgccagtgttttgactactatttaaatcatgaggatatctcattgtcacttataaaaaaataaaaatataggcaggctgttgtggctcatgcctgtaatcccagcactttgggaggccaatgcgggcagaacacgaggtcaggagttcgagaccaacctgactaacatagtgaaaccccgtctctactaaaaatacaaaaatttgtcaggtgtggtggcacgcacctgtaatcccagctactcagaaggctgaggcaggagaatcgcttgaacccaggaggcagaggttgcagtgagctgagatcgcaccactgcactccagcctgggagacagagcaagactctgtctcaaaagaaaataataataaaatatatatatttacaagatagtaatttacattcacaagaggattagatttcaaagtagaaagtttattttaataaaagagagataagaaatgattttcaaaatgaggaattgtgtttttgattaggaggaaaattgttctacctattctttttattctttatttatagaactttctctaagtgtctgtgatatatgtttattatactgaaatagtcgccgttttaaggtagtgtggcagatgttgttatttatttgaaattttaagttttttatttataaaatgtttttataaaaatttattaatataatttaaaaattacaaccagttaaccatgtgtatgatattagtgtttatagtatttaaacaaataaggctgggcacagtggctcacaccatcccagcactttgggaggccaaggcgggtggatcaggaggtcaggagaaggagaccatcctggctaacatggtgaaaccctgtctctactaaaaatacaaaaaactagccagacatggtggcaggtgcctgtagtcccggctactcgggaggctgaggcaggagaatcacttgaacctgggaggcagaggttgcagtgagccaagatcatgccactgcactccagcctgggtgacagagcgagactccatcttaaaaaaataaaataaaataaaataaaataaaataaaataaaataaaataaaataaaataaaataaatacaagattgttgtttcttataaactttttttgtatctttgcctatttttttcactgtttaaggaatttttattaaagcaaaattttataatccaaattacctttccttgctcagttatcaattctgttacttaaaacagaagtgacattattagctattccacactaatgaattacaaaattaaaggaatgctttaaatttttatactttgctgaaaattatttatcacagagtctgaaaagcattacagtgtttttatattttattattttgggaggattttttcttttcaaatcaataagtaatctaggactatcattgcatttgttagatctgacattttcttggtatgtaaagttcaaagtttcctttttaaatttattttatagtttacaaattttttccatagtatttaaggtttttgatattgagatatttttcttcagtgatgctcaagtttctttctgtggtccctgatcagttttaaacaattggaacaccagtggcaccattaactgctttctgggcagcctctttagcttggtgctcttgtagtacagctatacctttgtcaaccttagtatagagaggctctggagattcaagcatatgaaggagttctaaattaccaatctccaacaacatgccaatgattttaccagcacgactagggcatggcttgaagaagaggaaacagccattcactcgtttccttttgcttttgaggaggagcagatgccatcatggaagtcaaaggttcttgaccttctacatgaacagcaggctgctgcatggtaacctggggctgtgcatgaaaatatcattgaggattgtgagcttccatagcatatttatactgtgaaatggtacaaacagcaggagtatctgtagtagcagtagcggcaactgcaggatgtgctcctattgtctgtgtcgatgtgttacaacagctgtgttgacatgactcgtggaagctgtgaagaagctggtctcttactactaaatgtagtgagctaggagtggcttgggcatatttttcaatggatgaggtctggcaccctgagcaatttagggaggatttgatcttagttgagcagtttggctaggagaatactttgcagcatggctctcagtctgtgggataactgccatgaagtcaattgaagaaggtgctggctgatagggactgattcccaggttgagcatagtttttacacttgccattctttgcacatagtgtactggttaatgagctgagcctggtgctcttcattgcttttcttcccatggagttaacactatatacaatggctcagtgcccacaattctaccattcatttctgaaagtgctttagttgcttcctctggagaggagaaacatacacaaatcaaaccctttgttgtgacaaccatccttcataacctttgcattggtgattgtaccaagtggagaaagttctttccagagacattcatcaataccatcatgattttttgcataaatgttaacactttgttatctggtgatcctatactgcttgatcttttcaaatttgcacacaagttccatctgccattctacttctttctgagcttgaccaacatcaatttgttttccattgagcttctttctgttcatctcatctgcgcatctttatgcctttcaaagctgacaaatccaaaacctttgggttttccactttcattaaccactactatcacacttaagacagatcccaacttgccaaagagatctttaaggcacctaccatccatgtcttctccaaaaatcttcctgtaaacattggtgaactctttaactctgagttctgcttctcattgtttacaagacttaatccaacaaagactttgctatcatttagaagcatccatttcatttttgaatagatctttcagctgcttctgtgtctcaaaatgtacagtgccatcacccttgaaaccgttttcaccacaaagcacctaatgtgaaagtgatggagacaggaggcagccaagggtcccctggtaaaaccccaccttcaagactaaaacagcctgaaggctgataaactggactgcaggtccgggttgaagccgccctttcctcactgattctgaataatgcccacctgcgcactgggattacggggtggagcctcgggaagtttgtgcagtgtgcagtggagaggagtctggcctgttcccatgtagtgacctaggatttaatctatgaggcgggaaacccgctagcaggactctttctctctttgctaagagttatttttcctttttcctttccatccaataaactccgttccccctcacccttcaagtgtttgcgtgccttttcctggtggtatgacaagaacctggttttttctgcaacaaaaagatgttaccaaaagcagatgtatcatggaatgctttataatcaatagatttgtccaatttttttatgaacatgttgcccactccatttttgcggagtgatggatcacaccgagactacttagtgtgtattggctagtcttttataacatcaaaattcatggggtcttaaggacattccacatcctgcgtttcccaaggagcgccggtgatctggttcctgtagcccgggatagagaggaccagccagcaggcctggtcacgtggggtgcgaggacaggggatggctgggacgctgggctcacctcttcacctgtctgccggtagggccacaggctgcgacctttccgtgaaaggagagtaagggctggggcggaagcctgggccagggcagagagacaaaatcacctggaatctaaaactactccacggccgaggaactgcggcctgcagcgggctgggacgagggtggcggtgtagggtccagcgtccaggcctcgggatcctgttccttcttgaagctgcttcggagctgcgagtgggcgggtgggtcgctctcggctgcctcacgggtaatcttatacaagaagaaaaggaaaatgtctctggcagtgaagacaaggatttttttgtacagtgttttgcaggggtgatgggtgttaaaatagaaacctttttttttttaagttttttcatgggtttttttcaggggaatgggttttccaagataataaatatgtgctgatcctggagaacacactccacactctcggcactaaccgcttgggagaagggacccattaatgtttaattgtaccttctcttgtggccccgttatttcccttttaattatgaaacattggagcctacagaaaggtagaaaaaatgggcacccacataaccaccacctaaatccaattaattgttaatattttgtcaagttttctttatgtaatttttcaatttgaattaaaagtaaattataggcatcatgctaatttgcctgtgtatacttgagcctgcatattcaaaaactaaagccattttcttgcataaccacaattcccttatcctttcacaccaagttatcagtaattccttacaattattcaactcccaaatattttcaaatataaacagtcatgccccatgtaacacatttcagtcaactagtcgaccatctacactgtggtggtctcataagattaaactggaacatatatagaaacttgataaacagtttatggcccttgatattggcattgcagctcaagtagaggaaatgactaatgctcagtagtggtgctggaacatttgattttccttataaaaaataaataagtgaaaatatatagggccggatgtagtggttcatgcctgtaatcccagtgctttgggaggccaaggtgggcagatcatctgaggtcaggagtttgagaccagcctggccaacatggtgaaaccccgtctctactgaaaatataattagccgggcgcagtggcaggtgcctgtaatcccagctactcaggaggccgaggcatgagaattgcttgaacctgggaggctgaggttgcagtgagctgagatcgcaccagcactccagcctgggtgacacagtgagactctgtctcaaaaatatacgtatatataccatctaggtttgcataattacaccctatgattcacattttcttaattgttttccaattatagcaatttttaaaagccatgatccaatcgagaactggacactacattttgtttttgtctcttattttgtaatccagtacatttctccatacttaatcccttgctaaatggcatagacttttttttttttgagacggagtcttgctttgtcaccgggctggagtgcagtggaatgatcttggctcactgcaacctctgcctcctgggttcaagagatactcttgcctcaccctcctgagtagctgggattacaggcccctgccaccacggccagataattttttgtatttttactagagacagggtttcaccatgttagccaggatggtcttgatctcctgacctcatgatccaccctcctcagcctcccaaagtgctgggattacaggtgcgagccaccgtgcccagccggtattgacattttaaaggaaccatgctagttgtcacgtagaatatctcacattctggaattgtgggactgttcatggtttcatttagtttgtttgtctatcccctcaattttctgaaatttgaagttaaatttaaagacttggttacattcaggttaaacttttttggccagaatcattcaaaggtgatgttgtatacttccaatagtggcacattacgaagtttatgtctggttgtcccactgccagtgatgttaattttcattcctaaattaaggtggtgattgccagatgtctatatcgttaatggtatattttcctctttaattagccagtgatgtctgagattataccttggtactacatgaatatttattcttcatcaaatttctcaaaattagtagactttgttttttagagcaattttaggtttacagaaaccaatgagcagaaagtacacagagttcccatgtaacactaccttcctatcccactctccacccaatccctacctctgtacacaatttcccctattattaacaccatgtattaatgtggtatattggttacaattgatacatattgatacattactataactgaagtccatagtttacattagcgttcactctttgtgttgtaaagttctgtgaattttgacaactgtataatgacagatatccaccagtatcatatagaatagtttcatcaccataaaaatcctctgtgttccacctatgtatccctctcttactttctgcaaattgctgaaaaccactgatgtttctacattatagtattgccttttccagattgtcatacacttagaaccatacaatatatagccttcttatgctggcttcttttacttagcaatatacatttaagtcttctccatgtcttttcttagcttaatatctgatttctttttagtgctgtataatattcccttgtctggatgtaccacagtttgcatagccattaacctactgaaggatatcttggttgcttccaagttttggcagttatgaatacaactgttataaacagccgtgcacaggtttttaaggttttaacaaactctccctggcagtttctgtttttcctcacttttcaagcccatggactatctcccagtgctgttcattttaatattctgcagagtacttaagcattacagaatatagaagctggaagatacttggcagtcatttagtccctcatgttctagatgagaaaactgaagcccagataccttattatttgtgcagtcccctaatctgagtgtcaaatccacctctcccagatgttttctgttcaaataaccctgtgaacttcagtgaccctcactgaccacatcatcattattcaccaatagttctccaacagatccgctctacattagctcatttcaaatgttcttttcctttcacgcacataccatacagtacttaaaattttgttgacaacaatcaatatgaattcaaactaatttcttgccccaaggatgtgacttctactacacagttccttttggcctgagggcaattcctagggcatgaacttagtcatgtgccctcaacagacagcactctaaggaagctggggaatgagggtctccattctgcagggaggcctggactacacaccacagaagacactactctgtccatccctcgtgtcatttggatccatgacttcatataacttctctccatctaggaatagctcctccaggattttggttggtttcttttgctggggaaatgtgaaagtaacattcatggagggaacaatagctccttggctcttcaacttgtcttttatcagtgataaaagtgatcatctgcctttcctacgatacaggtactatcaggtttacattcttaccctcagctagcacctccactggtctaggtcacttacctggagataggagaggagggtgtagtagccatggctactagacttgtccttttaaattgagcaatcaaaatttagtaagggactacttaaacatcccttggctgccaaacacattcctgtctgcttccgttgtgtaacagcattgaattgcagagataagaagcagaaatttcctaagtgaatccctgggggtgacggtaaatagtgctactctttcttcaatccatggtcctctttctattagcgacatgggaccatataatggttactgatctaggatatatgcttgtatcccatccctgcagcttcaaagggctactggagactgttccatcactccatcagtttgacagcttctagttgttgtgatttcgtgatttgtaataggatcactgaattgcattttcatgtgtccaccactgcaactacagtgctacaaagtgcattccctttatacagtgctataaagtacaatgcaaggatgtgtaggattccatactggaggattaaacattctgtcaacccttggatagtggtgctggttgaggccatgtaagtaggaaagataaatccatactcagaataagtatcagttccagccaagatgaatcattacccttcctgtgatggaaagaatccagtgcattcagcttgccaccaggtggcaacttggtgtccttgagggatgatgctatcttgaggcctcagtgttgctctgtcttgatgacaactttgacattcagaagcagcagtagctagataagacttagacagtggagacttctgctgtttgggcctctgcatagcctccatccttgtcactatatttattcaccagtactgagctggccaatggaagaggatggctaacatcatctggctgagtcgcttttctccttggttgttgatagatacctcttgtaggtgttaacatgtgaaacaaagatcttcatactttttgtacatccccataagtccacccatatgcccttttctcagatgtctttttctccagtcatccaaattttctccttccatccccctgacctgtagccaagccatttgaccatgagtcagtacattcttactatgagtctcttctctttccatgcaaagtgaatgacaaggtgcgtagtgcaaagttctgccaactgaaattttttaatttttttattttttgagacagagtcttgctctgtcaccaggctggagtacagtggcgtgatctcggctcactataagctctgcctcctgggttcatgccattctcctgcctcagcctcccgagtagctgggactacaggtgcccgccaccacgcccggctaattttttttgtatttttttagtagagacggggtttcaccatgttagccagaatggtctcgatctcctgacctcatgatccactgccttggcctcccaaagtgctgagattacaggtgtgagccactgtgcctggccaagaatttatttttgagttgaatttttaaatattaaaactttttaaatatacaaacaaaaattgtatatatttggagtgtacaacctgatgttttgaaatatggatacagtgtgaaatggctaactcaagctaattaatacatgtgttacctcacatacttatcatttcttttgtggtgagaacacttaaaatctactgtcctagcaattttcaagtatgcaatacattgttattaactgtagtcaccatgttgtacaataggtctcttgaacttgttcttcctgcttaatttttgtatcctttgaccaaaatctccccagttctaccctcctccccccgcccctaataaccattattctattttctgcttctatgtgtttgacttttttagattccacatataagtgagattacatggcatttatctctctctgcctggcttatttcacttaatataatgtcctccagtttcatccatgttattataaaggacaggatttccttctttaaggctgaacaatatttcattatgtatatatacaccacattttctttaatcattcatctgttaaaggatacttaggttgatttcatatcttgtctattgtgaataatgttgcaatgaacatgaggtacagatttttctttgacatactgaatcattttctttgggtatataaatagtactaggattgctggatcatatggtagttttatttttaactttctgagaaacctctatattacttttcataatggctgtactaatttacattcccaccaacagtatacaaaggctcccttttctccacatcctcgccaacacatgctatcttttgtttttttcatagtagccattctaaaagggacgtctcattgtggttttgatgtgcgtttccatgatgactggtgatgttggttattttttcatattcctgttggccatttgtatgtcttctttggaaaaatgtttattcaggtactttgcctccctttcattaatcaggttatatgttttcatgctgttgagttgtatgaatactttatatattctggatattaatcctttatcagatgtatggtttgcaaatattttctccctttttgtaggctatctctttactctattgattgctccctttgcttgcacagcttattagtttgatataatcccttttgtctatttttgcttttgttgcctgtgctttgggggtcatatccagaaaatcattgcccagaccagtctcatggagcttttcctgtatgttctcttctagtagttttatggtttcaggttttatatttaagtctttagtccatttgtgttatttttttgtatatggtgtgagataagggtctaatttcatttctctgcatgtggagttctcccaacaccatttattgaagattgtcctttccccattgtgtattcttggcatatttactgaaaatcaattggccataaacgtgaatgtattttgaggctctctattctattccattggtctaccagtctgtttgtatgccagtatcatgttatatttttgattactatatcatcatagtatattttgaaactggataatgtgatgcctcctactttgttcttttggctcacaatttgctatttggggttttttgtggtttcacatgaatttggggatttttttctgtttatgtaaaaaatatcattggaattttgatagagattacattgaatctgtagatcacttttggtactaagaacattttaacagtatgaattcttctaatccatgaagatgggatatgtttccatttatttgtgtcttcttcaatttctttcaccaatgttttatagttttcagtgtacaggtctttcacctccttggttaaattaattcctaagtatttgtgtagccattataaatgaaattgttttcttgatttctttttcagatagttcattgttagtgtatacagatgctagtcgtttttttatgttgattttgcatcctgcaactttactgaattaatttactagttccaacagtttttttttggtggactctttagggttttctacatttaagatcatggtgtctgcagagacaatttcacttcttcctttctgactttaatgcctttatttcttcttcttgactaattgctagaacttgaatagaagtggtgaaaatgggcatccatcttgtttctgatcttagagaaaaagctttcaactttttaccattgagtatgatgttagctgtgggcctatcacatatgcctttattgtgttatgtggacattgatacctaatttgttgaaagtttttattacagaaagatgttgaattttgtcaaatgctttctctgcatccatggagatattcatatagttgtcgtccttcattctgttaatgtgtatatcacatttattgattcgtatatgctgaaccgtccttgggaggatttaatctactgctatctttccatagctgaagtaggctgctatcattttttacttacatccgcatgctgagttgatcttccaatgaacaagcttagcttttttcctcctttatcaatattggaactcccacataggcagagttgccagctgagggagagaatctagtgtcacaatttggataatgtggggacctggatcaccttatcatactgcttacttgtgtcctctagtctttctcatgcccaatccttgatgtgatatggtttggctctgtgtccccacaaaatctcatctcaaattataatccccacatgtagagagagggacctggtgggaggtgactggatcatgggggcagtttccctcatgctgttctcatgatattgagtgagttctcatgagagcggatggtttaaaagtgtttggcacatccccccttgctctctgtctctcctgctgccttgtgaagaaggtgcctgcttcacctttgcctttagtcataagtgtaagtttcctgagacctctccagccatacggaactgtgagtcaataaacctcttttgtttattaattacccagtcttgggtagttctttatagcaatgtgaaaatggactaattcaatgtgctacttctattttattatgatttgttgctgggccagcctgtccttatgatctggtagatctaacaaaaccaaactcacagtgggaacttttagctacatggtcacttaatatttgttgtcagatagtccatctctacctaggtgcagtagcatgctaggagctattaaagtacacaattatgctatatatttatacaatatacaattatttgcagatagcatgaccatgctagtgaaccccacaagactatgtgtgaatcatctattagggtttgctataaactctacgtggtgctttttccaactgcatatatttctaataccatagagcctactagattgtatggctcaaacagtagggctgcttgccctggatcctggacctgctgcagaggccttttctgccgtaagcttttgtcaaaagtggaagccttctgtgtcactcagcaaatgtgtcagaacagtattccttagtatggggggggaacaatgggccccctaaaatcttctgtgactgatgtcacaggtccttaaatcttcagatgattttctctctcagggatgcttgtgtctctctaggccatccaacatgttatttcttacccagtctattttaactggtaaataaaatggaaaaatgtaacatgctacagaatgtccagacagctcaggtctctggactacattaggacagagagtcaaagaactaatatacatcttggacaagtctctaaatgcatgctgttgtccttcccatgaatgtgaattgcttctggtaaatttcactgtaagtactgcttcagttattttacatatatattgatcggtaatcttttcattttaattcaattttaagcatgttctaatttttattataatttcttcttgcttccatgaatcatttggaagctatttgtagtttctaaaattcatggattacttttggataagtttttgttattgatttctaatagtgctattacacatttgttataccaatgtaaacatttgatactatctttaggcctaatatctggtcaatttttgtaaatactccaagtgtgcttgaaaagaatcaaaattctttaactgttgattagccttactaattttatgtttatttattcaattactaaaaatgaaatgttaaaatatctcactgtgtagatttttttattgctctttccaattctaattttggctttatttattttgagactacattattaggtatccacaattttataaaaattaagaaaaaattagaaaagtttagaaaaaaaatagaaaaatatagaaaaagatgtgaaagaagcacacatgggctttatctggatgatctcttgtcaggtttgtatcctggggaaggccttcacagcaagagatggaccagaggattgagacaagggggccaccactcagaaagggaggagggcaaaggaactcctgagggaggaaaggatcagagaggaggctttcatgtctcagtgatatcactcagcagcatggcatggagtctgtagttcacagagttccaaagagcagaagcagtttggggtctttacagcctagagtttatctgtggcaagcagattttggatgtagtttcccagggcatgtaaatcaggcaggctctaaatgcctacaaatatgcatgtctgggctatgtttaacacaattggatgtttaaaaatttgagtttggtgccagttggtttttgagctaatgggtttcagcttgctgtgaagaaataacctaggcgccaatacacagaggccatccttgtctcatttacattatatgcagtgactctatccttttttgctcataattgttttattcatttcttttagatttgtttactttactgagattatttggtaggtaagatttcagtttattgtagtttgctaattcattattcaaagtgttctaataaaaattttgctccatccttaatccccatttaaacaaagctgctgtgggtaaggtcatcaatggccttcgtgtcatcaaatccattttgttaacaaaattttaatgtttaaaattttcttatgtgtacacgtttaatttatgtaatttcaaaacggggtatcacacatggaatttggtagttttctttcctttttttattcacttactctgtttcttaatgctttactgtaacccacagcgcaatgtccccaatatttattatgtataactgatattcacatacaacatatttcgtcattaagtgttatctttttccacataggtgttcctgtctttagtcttctattttctctctctcccgcttctctcccacccttcctctctccatttacgtacgtatttaaatcattttaaaaatcattttatgtatcacttcaaagccttcagtgtaaattgagggtccaattttgttttctttgaattgtttattttcatatattaatttttcatctacatgtagattctcaattttttaccactcttgcttattcttaattaatacaattgtttttcttaattgatcaattccaatagttctatagtaggtgctgatatctggtgagaaaagttcctctcaatagtcttttttttggtacaattttctgactattcttctacatgaactttaagataatttaatccaattttaaaatgcttttgtgattctaatgttaatttaattgaatttatatataattttaggagatttatgcttttacaagagttttgttgtttgtttttttgagacagggtctcactgtgtcaaccaggcaggagtgcagttgtgggatctcagctcactgaagccccaacctcccacctcagcctcccaagtacctggttctataagcatgcgccaagcccaaatagttttttgttttgttttgttttgtttagagatagggtttcacaatttgccaaagctggtcttgaactcctgggctcaagcagtcctcctgcctcagcctcccaaagtgctgggattacaggtatgagccactgcgcctagcctcatgtgtttcttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatagtctcgatctcctgacctcgtgatccgcccgtctcggcctcccacagtgctgggattacaggcgtgagccaccgtgcccggccatgtgtttcttattcaacagcttttggtaacatttttatagtttttttcttatagatcttctttcttggtaaatttattttacctttattatttttgttattgtgaatatttttaccattagcatttcaaggtgcttattgctaatatattttgtattatgatcttatttccaaatgccttaccaatattcctctttaaaatatttgaaagttctgtttttcctaatctctatgatttcctaggcatataatcatatccacaaaaagctttctatatatttatactgattatttcatttaaaaatcttgttacattcatggatcctccaagataatctttaataacaaatactgacagcagctattcctgctggttccttgttttatttgaaatgttcctttatgatttaaaatacttgttttgtaggcatttcataaatagcggttatgtttagacactttccttcaatttctattttactcaagaatcttcattaggagtggatgtttaatcttaacaatagccctctcagcatctactgatataatcacattttcctcttctttgatgtcaattatgtaattgtgttaatatacttaactgatattgaaatacccgtgaattcctgaaatacaatgctctttgcatactgtattactcttttttgttgttgcaattattgataaaagtgctgggtttttatttagaatattcattcatatgtataagtcagattggtctatagttttggtttttttgttttttttttttttgttttgagatggagacttgctctgtcacccaggctggagtgcagtggcgtgatcttggctcactgcaacctctgcctcctgggttcaagctgggattacagacatgcaccaccaagccgggctaatttttgtatttttagtagagacggggtttcgccatattgtccaggctggtcttgaactcctgaccttaagtgatccacgtgccttggcttcccgaagtgctgggattacaggtgtaagccatggcatctggcctatagttttgtcttatgtttatcaggttttcatattaatgctgcactgcctatgtgaaatgaattggtttttcttttttaaaaatatttgggatactttaaataacattggaattatccttcttgcaaccctagtacttttttaaattatggatttaaaaaatcactttacattctttctttgtaactggtctattaacattttaaatttcttcttggattagttttggtcatttatatttttccagaaaattacccattttctctagattttccaatgtgtggccatatagttgcatgcagcatttcaaagtgaatctttcttttttcttttcttttttttttttttttttttttgagatggagtcttgctctgtggcccgggctggaatgcaatggcatgaccttggcacactgcaacctctgcctcctggattcaagcaattcttccacctcagcctcccgagtagctgggattacagacatccgccatcatgcccagttaatttttgtatttttgtagagacgagttttcacaatgttggccagtccattccattccattccattcattccattccattccagtccatttcattccattccattccattccattccatgacagtccattccattagagtccagtccaatcaattccattctattccattcgagtccattccattccattttattcgattccattctattccattactttcgaatccattccattccattccattcgagtccattccatttcattccattccatttcattccattcgagtccattccatttcattccattccattccattccatttcattccattcgtgtccattacattacattacattacattacattacattacattacattacattcgggtccaatcgattctgtgccattcttgtcccttccattcgattagagtcccctccattcctttgcattccattcgagtccatttcattgcattccatttcattcgagtccattccttttcactcaattccactcgagtcaattccaatccactccattccattcgagtacattccattccattcgagtccattccattctattccattcaaatccattccattccattccattccttttgattcgagtccattccatttcattcaagtccattctgttccattccactccattcgagtgcattccattcatttccattccattccattccttttgggtccgttaaattcaactgcattccattccattccgttccattccattccattccattcgggtccatttcattccattccattccattcgtgtgcattccattccattagagtccattccattccattaattttgattccattccattaattttgattccattccattccattccattctattccattagtttccattccattctattccattagagttcattccattccataccattccattccattccactcctttccattccatccaattccatgccttgccattcctttcgattccattccatttgggtccattcaattccattccatttgggtccattccattccattccactccattcgggtcctttccattcctttccattccattcaagtccctttctttccattccattccattccattctggttttttccattccatgccattcaagtccattccattccattccattcaaatccattccattctactagagtcaattcctttcgagtgaattccattccattccattcgagtccattccattccattacattaaattagtgtttattccatcccatcccattcgagttcattcaaatccattccaatccattcgagtccattccattgctttccaatccattcgaatccattgcattctattaaattcaagcccattccattctgttcaattccattcgagtccagtccattccattctgttccattgcattccattctattcgagtctgttccattccattccattccattccattctattccattcgagtccattccactgcattccattcaggtccattccattcccttcctctagagtccattccattaaatcccattctattccattcaagactcttccattccattccattccattcgtttccattctattccatttgagtccattccattccattccttttgagtccattccattcaattccattctctttcaatccaatcaagtccagtccattccattccattcctttccattccattcgattccattccattcgggtcagttccattcctttcccctcctttcgggacattccattccattctattccattcgagtccgttccttttcattgcattcaattcccttcaagtccattccaatgcattccaatccattcaagtccattccattgcattccattccgttcgagtccactccattgcactcaagtcatttccattccattacatgccattcgaatctattccattccattccattccattcgagtccattccattgcattccattccaatcgagtccaatctactccattctattccattcgagtccattccattccattccatgagattccattccattagagtccaatccattaaattccattctattccattcgagtaaattccattccattccattcctttcgagtccattccattccattccattcaagtccattccattccattccattgcatttgagcccattccattccattccattccattccattccatttcattcatgtccattccattccatttcattccattccattccattccattcgggtccatttcattccatgccatttgtgtcccttccattccatttgagtccatcccattccattctattccatttaatttgaggccatttaattgtattccatttcattcgagtatgttccattccactccattccacacgagttgattccattccactccataccattcaagtccatcccaatccattccagtccattccattcgagtccattccatttcattgcattccattccattccattgcattccttttgaatcatttcaattcaactgcgttccatgcgattccattccattccattcaattacattcttttcgggtctattccattcgagtccattccattcgagtccattccattcctttccattcgactccattccatttcattctttaccatttcagtcctttgcattccattccatttgagtccattccattgctttccattccttttgagtccatttctttccattgcattccattccagtcgtgataattccatcccattccattcgagtctattccattccattccattcaagtccattccattccactcgagtcaattccattcgagtcaattccattccattacattcgagttcattccattccattccattccattagagtttattccatcccattcctttcgagtccattcaaatcaattccattccattcgagtccattccattgcattccattccattcgagtccatttcattctatttcattagtgtccattccatccataatattccattcgtgtccagtccattccattggagtccattccattccattccactctcgtcatttccattccattccattatattcaagtccattgcattcctttccattccatgccattccactcaagtggagtccattccattccattcgagtccattccatttcattcgtatccattccgttctattccattccattcgagtccatttcatttcattgcattccattccattccattcctttcgaatcaattcaactgcattccatgcgagtccattccattccattccattccattccattcagttagattcctttcgagtccattccattcgagtccattccattcatttccattcgactccattccattccattatttaccatttcagtcctttgcattccattccatttgagtccattccattgctttccattccatttgagtccatttctttccattctattgcattccagtcgtgataattccaacccttttcattcatttgtattccattccattccattcaagtccattccattccactcgagtcaattccattcaagtcaattccattccattacattcgagttcattccattccattccattagagtttattccatcccattcctttcgagtccattccattccattccattccaatccattcgagtccattccattgcattccattccattcgagtccattccattctaattcattcgtgtctattccatccattatattccattcgtgtcccgtccattccattcgagtccattccattccattccactcgagtcatttccattccattcaagtccattccattccattccactcaagtggattccattccattccattccatttgagtccattccatttcattcgagtccattccgttccattccattggtgtccattccattccattccattctaatccattccattcctttcgggtacattcaattcgactgcattccattcaagtccattccattccatttcattccattccattccattcgggtccattccattacattcatgtccattccattccattcgagtccattccattccattaattttgattccattctattccattccattctattccattagagtccattccattccataccattccattccactccataccattccattgcattccattccactccattccattccattccattccattccattccattccattaaacgccttgccattccattcaattcctttcctttcgggtcctttcaattccattcaattcgtgaccattccattccattccactccattctggtcgattcctttcctttccatttctttcgagtctatttctttccattccattccatttcattcgtcttaattccattccattccattcagcttaattccattccattccattcgagtccattccattccattccattagaatttattctatcccatcccattcgagtccattcaaatccattccattgcatttgagtccattccatttcaatccattcgagtccattccattgctttccattccattcgaatccattccattctattacattcaatcattccattccgttccattccattcgtgtccagtccattccataccattccattcgagttcattcctttccattccattccatttgcgtatattcgaatccattccattcgagtccattccattccattccattcgagtacattccgttccattccagtccattcaaatccattccattccattccattccattcttttagagtccattccattaaatcccattctattccattcaagtctgttccgttccattccattcgagtccattccattccattccattcgagtacattccgttccattccagtccattcaaatccattccattccattcttttagagtccattccattaaatcccattctattccattcaagtctgttccgttccattccattcgagtccattccattccattccattcgagtacattccgttccattccagtccattcaaatccattccattccattcttttagagtccattccattaaatcccattctattccattcaagtctgttccattccattccattccattgcattcatgtccattcttttccatccccttacattctagtcaattccattccacctcattacatttcagtccattccattccatgccattccatttgagtccattccattcgattccattccgttccattccatttgtatccattccattccattctttcccatttcagtcctttgcattccattccagttgagtacattccattcctttccattccattcgagtccatttctttccattacattcatgataattccattccaatccattagagtccattccattccattccaatccattagagtccattccattccgctcaagtcaattccgttcgagtcgattctattcctttacattcgagttcattccattccattccattccattagagtttattccatcccattccattcaagtccattcaaatccattccattccattctagtccattccattccaaatcattcgagtccattccattgcattccattccattccagtccattccattctatttcattcgagtcctttcaattccattccattccattcgtgtccagtatattccattcgattccattccattacattccattccagtcaattccattccattccattctaattgagtacattccattccactcgagtccattccattcaattccattcgagtccattccattccattccattctattccattcgagtccatttcattccatttgactccattacattccatttcatttgaatccattccattccattccattctattccattaaagtcctttccattccactccattccattatatttgtgtccattccattccattcaagtccattccattccattctttccattcgcgtccattcctttccattccattagagtccattccattaatgcccaaaccaatgaattccattctattccattcgagtccattcaattccattccattcccctcgagtcgtttccattccattccattccacctgagtcggttcctttcctttccattccatttgagtccgtgccatttcattcgagtccattccattccattccattccattccattcgagtcccttccattgcattccattttagttcattccattcctttcaggtccattcaattcaactgcattccattcaggtccattcaattccattccattccattccattccattccattacgttccattccattccattcatgtcgattccattccattcgtgttcgttccattccattaattttgattgcattccattccattccattctattccattagagtccattccatttcataccattccattccatgcctttccattccattcgattccattccattgggttccattcaattccattccattcgggtccattccattccatttcactccatcctggtccattccattcctttccattccattcaagtccatttcttttcattcaattccattcgggttaattcaattccattccattcgcgtccattccattccatttcactccattctggtccattccattcctttacattccattcaagtccatttctttgcattctattccatttgggttaattcaattccattccattcgagtccaatccttaccattaaactccattccattccacttgagtcagtttcattcgagtgaattccatttcattccatttgagtccattccattccaatccattccattagagtttttcatcccatccctttcgagtccattgaaatccgttccattccattcgagtccattccattccaatccattcgagtccattccattacattacattacattacaatccattccactctattacattcaagtccattccattacgctccattccattcacatccagtccattccgttcgagtcaattccactccattccattccatttgagtacattcaattcgattccattcctctcaagtccattccattccattctattctattccattccattccattccattcgagtccattccattccattccatttgagtccattccacttcattccattccattccattccattcgagtctattccattccaatccatttcttttggttccattcctttcaattccattcgagtcaattccattccattccattcgattccattccactgcattccattttagtccattccattgcattccattacattcgagtccattctattctattcaattcgtgtccattctttgctttccattagattccattcgattacagtccattctgttaaattccattccattctatccgagtccattccattccattcaagtccattccattccattgccgtcaagtccgttccattccattcaattttattccattcaagtccactccatttcattccattccattcaagtccattccatgccattccattccatgcgcgtccactccgttccactgcattcaagtccattccattccattccattttaatcaagtccactaaattccattctattccattcgagtcccttccattgcattccattcgagtccattcccttccattccattacattagagtcctttccattaaatcccactctattccattcaagtctattccattccattcgtatccattctattccattggagtccattccataccattccattccattccattcctttccattccattcgattccattcaatttgagtccattccattccaatgctttcgagtccatttctttccattccactccattcaggtccattcaattccattctattccattcgagtccattcctttccattgcattcctttccaatcgggtccattccattccattcctttcaactccattccattccattccaatccattcgagcccattccattccattccattccattccattctcattcaatccattccattccattccatttgggcccattttattccattccattcgaggacataccatttcattccattctgttccattcaagtccatttcattccatactattccattccattccagtccatttcattccattccattcctttccattccattcagtccattccattcgaatgcagtggtgtccattcctttccattctattgcattcgagtccattccattccttcccattaaattcgagtccattcctttctatgcctttccttttgggtacgttccattccattctaatgcattccattccattccatttgggtacattccattcaattccattggagtctgttccattcaattccattccattcgggtccataccattccattccattccattcgagtccattccacttccttcgagtccattccattccattcaatgccattcgagtccattcctttccattccattccattcgagaccatttcataccaatccattcctttccattacattcggtttcattccattccattctattcgagtacattccattgcattccatttcaatcaggtccattccattccattccattgcactcgagtcgattctgttctattccattccattccattccattccaatcctttccattccattcctatcgagtccattgcatttaactgcattccattcgagtccattcctttccattccattccattcgagtccattccgttccattcgggtgcattccattccattccattccattcagtccattccattcctttccattccattccactcgagttcattgcattccattccattacattcgagtccattccattccattccattccattctagttcaatccattcgattccattccattcgggtccatttgattccattccattcaagtacattccatttcattccattcttttccattccattccattccattcatttcaattccattgtattcctttccattccattccattccattccattccactccattcggctccattccattcaattccattgcattccattcgggtccattccattccattccattccataccattccattacttttgggtccattccattcgagtccatttgattgcattccatttcattcgagtccacttcattcgaatccattcctttcgagtccatttgattgcattccatttcattcgagtccacttcattccatttgaatccattccattgcattccattccattcgagtccattccactttattccattcgagtccattccattccattccattcctttccattctagttcaatacattcgattccattccattctggtccattttaatcctttccattccagtacattctatttcattccattcttttccattccattccattccgttccattctattccattccattccattgcattccatttgggtccattccattccattccactccattcctttccactccatctggctccattccattccattccactgcattccattcgggtccattccattccattcaagtccataccattccatttcttttgggtccattccattccattccattccagtccattcgattgcattccatttcattcaagtccacttcattcgattccattccattcgagtgcattctattccattcgagtccattccattccatgtgagtccattccattgcattccattccattcgagtccattccactttattccatttgagtccattccattccattccattccaatccaatccattccattctgctccattccattccataccattccattgctttcggttccattccattccattccataccattccatttctttcgggtccattccattccattctattgtcatccattcctttccgttccattccatttgaggccattccattccatcccattacatccaagtccattccattccatgccattactttcaagtccattccataccattcaattcaggtacataccgttccattccatgagagtccattccattcccttccactccattccataccattccattccattccattccatttgggtccattcaattccattcctttcgagtccattttattccattccattccgttccattccattggaatccattccattccattccattccataccattccattccatatgagtccattcaattccattcctttcgagtccattgcattccattcgagtacattcctttccattccattccattcgaggccattccattctattcccttccattacattcgagtccattccactggagtccattccattccattcgagtccattccattctattcccttccattacattcgggtccattccactggagtccattccattccattcgagtccattccattctattcccttccattacattcgggtccattccactggagttcattccattccattagagtctattcctttccattccattcaattccattccattcaggtccattcctttccattccattcgagtacattccacttcattccatgctattccattcaagtccattccattccacactattccattccattccattccattccattcgggtccattccattccggtcccttccattccattccattccattctggtccattccattcgggtccattccattccattccattggagtccattccattccattcgggtccattccattccatcccattcgagtccattccattccatcccattacttttgagtccattccattccatcccattacattagagtccattccattccatcccattacattagagtccattccattccactctattccattccattcgtatacattccattccattccattccattggattccattccattcaattccattccattcgagaccataacattccattcgattccattcgagtccatttcattccattccatacgactccattccattccattccatacgactccattccattccattccgttccattcgagtccattcctttcccttccattccattcgagtccattccattcctttccattacttttgggtccattccattcccttcctttagagcccgttcgtttgcattccatttcattcgagtccagtccattccattcctttcgagtccattccattccatttgagtccattccattccattccattcgagtccattccatttcattccattccatttcagtccattccactttattctattcgcgtccattccattccatgccatttcattccattccatttcagtccattccactttattctattcgcgtccattccattccatgccatttcattcatgtccattccattacattcgactccgtttcattctattccattcaagtgaattccagtccattgcattgcatttgagtccattccaatccgtaccattcgagtaaattccattcctttcaattccactcgagtccattccattccattctattccactcgagtccattccattccattctattccactggagtccattcctttccattcttgtccattccattccatttcatttgagtccaataaatttcattccattcgaatccattgaagtccattccattccattcattccattccattccattcattccattccattccattcattccattccattccattccactccatttcacaccattccattccagtccattcttgtccattccattccattagtttcgagtccatttcattcctttctattccattcgagtccattccattcctttccattagagtccattccattatagtataatcctctaaattccattctattgttttcaactctgttccgttccactccattccatttctgtccattccattccattccatttgagtccattccatttaattccctttgattccaatccattccattccattctattccacacaattcctttctattccattccattccattgcattcctacccattcctttccattccattccattcggttccattctattccattccattgcattcgagtccattcctttcttttccattccattactttaaattccattcgagtccattccattccattccaatccattcgaatccattccattccattccatttgagtttaatccattccattccattccatttgggtcctttccaatccattccattcgagtatattccatttaattacattgtgtcccattcaaatctattccatttcatatcattccattccattccagtccatttcattgatttccattccattccatcccattccattccattccattggagtccattcgtttccattccattgcattcaaatccattccattccatcacattaaattcgagtccattccattccatgccattatattcaagtacgttccataccattccattgcattccattccattccattccaattgggcacattccattaaatttcattagagtccattccattcaactccattccattcaaatccttaccattccattccattcgagtcaattccattcaatttccttcgagatcattccattgtattcaatgccatttgagtccattcctttccatttcattcctttcaagtccattccatgccaatccattacattccattacatttgggttcattccattccattctattcgagtccattccattgcattctatttctttcgagtaaactccattccattcaattgcactccagtcgattccattctattccattcttttcctttccattccattcctttccattccattcctttcgagtccattccatttaactgcattccattcgattccattcctttccattccattctattcaattccatttcatttgagtccattctattctattccattccattagagtccattcgagttcaatccattcgattccattccattcgtgtccattttattcaattccattcgagtatattccatttcattccattctattccattcaagtccattctattccagtccattccattccattccattccattccattctattccattctataccattccattccattcgggtccgttccataacattccattgtagtccattcctttccattccattccattcgagtccattctgttccatcccattacatccgagtccattccattccatgccattacattcatttacattccataacattgtattccatttcattcgggtacatatcattccattccattggagtccattccatcccattccattcgagtccattcctttccattccattccattcgagtccattccattctattcccctccattacatttgggtcctttccattccattccattcgagtccattccattccattcaagtccattcctttccattcctttccattccattcgggtccatttcattcaaatccattccttttgagtccattctattccattccattccattcgagttcaatccattcttttccattccattcggatccattccagtccattccaatcgagtacattccatttcattccattctattccattcaattgcattttgttccacaccattccattccatttcggtccattccattccattccattccattcctttcgggtccattccatttcattcaattccattccattccattgcattcgggtccattccattccattccattggagtccattccattccatctcattccattctattcgaatccattccattccatcccattacattcgagtccattccatttgatgtcattccattcgagtccattcgattccattccattccattccattccattccattccattgatgtacattcccttccattgatgtacattcccttccattgaattggagcccattccattcaattccattccattcgaatacataacattccattccattccatttgagtccattccattgcattccatttcattcgagtccactccattaaattccattcccttcaagtccattccatgccattccatgctattcgactccattcctttccattccattccattcgagttcattccattccaatccattacattccactacattcggttccattccattctattcgagtccattccattgcattccattacattcaagtccactccatttcaattcattccactcacatcgattgaattcctttccattccattccattccatgcctttccattacatcccattccatgcctttccattccattctattccattcctttccaatccattcctttgtttccattccattcaactgcattcaattcgagtccattcctttccatcccactccattcaattccattcgaatgcattccattccattcgagtccattccattccattccattgaagttcagtccattcgattccattgcatttgggtccattccattccattccattcgagtacattccatttcattccattctattccattcaagtccattccattccataacattccattccattcctttcgattcaattcggttccattccattccgtttcattccattccattccattcgggtcaattccattccgttccattgtagtccagtcctttccattccattccactcgagtctattccattctatcccgttacttccgagtacattccatcccatgccgttaaattcgagtcaattgcattccattgttttccattccaatccattccattccattccatttgggtatatcccattccattccattggagtccaatccattccattgcattccattctattccataaaactcccttccattccattccagtccattcaattccactgcctttgagtccattccattccactccattccattcgaatccattcctttccattccatcccattcaagtccattccattccattcccttctataacattccggtcctttccattccactccactcgagtatattccattgcatttcctttcattcgagtccatgccattccattccattccagtcgagtcgattccattccattccattcgattccattccattccattcgagtccattccattccattagattccattccactccattcatttcaattccattgctttcgagtccatagcattcaactgcattccattcgagtctattcctttccattacgttccattccattttattccattcgagtccattccattccattccattcgagtccaattcattccattacattcgagtacattctattgtgttacattccattcctttgcagtcctttgaattccattccattccatttgaatccattgcattccattccattcgagtccattccattctcttccagtcgagtccattccatttcaatccattagattccattccattaaatttcgttccattccattcgagtctattccattacatttcattcaattcgagtccattccatttgagtccattccattccattccttttgagtccattccattcctttccattcgaatccattccattccattcccttcgagtccattccattcctttccattcgagtccattccattgcattccattccattcgagtctattccactttattccattcgagtccattccattccattcgcgtccattccattacattcgactccattccattctattccattcaagtgaattccaatccattccattgtattcgagtccattccattcaattccactgagtgaattccattccattccattccactcgaatccattcctttccattgcattcatctcaagtccatttcacttcattccatttgagtccattccattccattccattccattcgagtccattccattccattccatttgtgtccattccattccgtttctttcgagtccattccattccattccattcattccattccattccagtccatttcattccattctattccattccattccattccattccattatattccattcgaatccattgcattcctttccattagaatccattcccttagagtccaatctggtaaattccattctattgcattcaactccgttccattccactgcattccatttgagtccattatattctattcgagtccattccattcaattccattcaataccaatccattccattccattctattgcattaaactcctttccataacattccattccattgcattctagtccattccattgaaatccattccattccattcgtgtccagtccattccatttgagtccattccattcaattcgagtccaatcctttccattccactccattcaattccattcaattccattccaatccattccaatgcattcgagtccatgccattccattccattccattcgacttcaatccattccattcacttccattacattccattccattcgagtacattccctttcattccattctattccattcaagtccattccattccatacaattccattccattcttgtccatttcattccattatattccattccatccattcgactccattccattcggtccattccattctattccattggagtccattcctttccattccattccattccagtccattccattccatcccattacattcgagtccattccattccatgccgttacaatctattccattccattccattccaatccattccatttgggtacttccattccattccattggagtccattccattcaattctattccatttgattccttaccagtccattccattccattcaagtccattccattccattcccttcgagtacattccattccattccattccatgccattcgagtccattcctttccatttcatttcatttgagtccattccattcctttccattccattacattcgggttcattccattcctttcaagtccattcctttgcatttcatttcattcaagtccaatccattccattccatttcactagggtcgattccattccattgcattccattcgagtccattccattctattccattccgttccactccattacattccataacattccattcctttcctttcgagtccattccaatcaattgcattccattcgagtccattcttttcattccattccattcaattccattcgagtccattcttttccattccgttccattcaattccattcgagtccattccatttcattccattccatttgagtccattccattccattccattcgtgttcattccattccattccattccattccattcgaatacattccatttcattctattctattccattcaagtccattccattccattcaagtccatttcattcaataccattccattccattcgagtccataccattccattccattcaattccgttccattgctttctggtccattccattcctttccattggagtaaattcctttgcattccattccatttgaatacattccattccatcccattacatttgagtccgttccattccatgccattccattccatgcctttccattggagtccataccattccaatccattccattcggttacattccattccattccgttggagtccattccattccattcgagtccattccattccattcccttctagtccattccattccattccagtccattcctttccattccatttcattcgagtccattctattccattcccttccattacatttgggtccattccttttcattccattcgattccatttctttgcgttccctttcattcgagtccactcttttccattccattccaccttagtcgattccactccattcccttccagtccattccattcaagtccattccattccattcccttcgagtccattccattccactccactctaggccagtccgttcctttccattcaatccattcaagtctaatccattccattccattcgagtacattccattgcattctctttaattcgagtccactccatttcattccattccacttgagtcaattctattccattccatttgagtcccttccattccattcgaatccattccattccattccattcctttccattccattccttttgagtccattccattcaactgccttctattcaactctattctgttccattccattccattacattccattgcattcgagtccatttgttccatttcattcgagtccatttcattccattaccttccatttcattcgtgtcaattcctttccgttaccttccattccattcgagtctattccattccgttacattccattcctttcgagtccactgaattccactccattccattctaatccattgcattccattccattagagtccattccattctattgcattagtgtccattgcattcaattccactggagttcattcctttccattccattccattcgaatccattccattccagcccattacattcgagtccattccattccatgccattacattcgattccgttccattccattccattccaatctattccattcgggtacttccattctattccattggaatccaagtcacttaattccattccattcgagtccttaccattccattccattccattcgagaccattccattccatgcccttcgagtcctttccattccattccatgtcattcgagtccattcctttccattctatttcattccagttcattccattactttccattccattacattctggtccactccattccataccattcgaatccattccattgtattccatttcattcgagtccactccattccattccattccactagagtgcattccattccattgcattccatttgactccattccattccattcgagtccattccattccattccataccattccattcctttccattccattcctttcgagtccattccagtcaactgcattccattcaagttcattcctttccattccattacattgcattccattcggctccattccattccaatctattccattcgagtccattccactccattccattccattccattcgatttgattccattccattcgggtccattccattaaattccattccattaaattccattccattcgagtccactccattccattccgttcgaatccattccattccattcgagtccattccaccccattccattgcattcgattccattgcattccacactattccattcgggtccttcccattcaattccattcgagtcaattccattccattccattccagtccattccatctcattccaatccattctttttgagtctgttcaattccattccattcccttcgagtccattccattccattccattagagtccattgcattgcattccattccattcgggtccattccactctactcagttggagtgtattccattccattccattcgagtccattccaatccaatccattcctttcaagtccattccattccattctatttgagtccattccattccattccattgcattccattccattcgaataaatgccattcccttctgttccattctataccattccattccatttgagtcaattccatgccattccattccattccattccattcttttccattccattccattccactccattcaatgtgagtccattccattgctctccattccattcaagtctgctccattctattccattcgtgtgcattctattccattccattcgagtccattccattctattccattcgagtatattccattccattcctttccactcgagtctattccatgtaattctgttcgagtccgctccattccattggagtcctttcccttccattgcattcattctagtccattccattccatgctactccttttgactccattcctttccattccatttgagagcattcctttccaacccattcctttcaggtctgttccattccattccattcgaatacactccatacctttcctttccattcgagtctattccatttcttgccattccattcctttccattccattccattcgagtccattctattcaattccatttgagtcaattccattcaattccattcgagtccattccattacattcctttccattcaattccagtccactttatttcattcgagtgcactccattccattccattagagtaaattccattaaattccctagtataccatttgagtccattccattccattcgagtccattccattccattcaggtccattccattccattcgtgtccattccattccattcaattcgagtccattctattccattccattcgggtccattccactccattccattcgagtcctttccattccattccatttcattcctttcagttccattccattccattccattcgagtccattccattccattacattacattcctttcagttccattccattccattccattcgagtccattccattccattacattacattacattacgttcgtctccattccattccattccattctactcactttgtttcaattccattccattagtttctagtccattccagtccatccgagtccattccattccattcgagaccataccattccattccattaaattcctttctagtccattcgattccattccattccattttagtctattccattccattctattccattccatgccattccattccattcatgtgcattccattccattcaattcaattcgactccatttcattccgttacattccaatccattctattctattccataacattacattccgttcaattcaagtccattcaattccatttcattccattcgagtccactccattccattcacttcgaatccatttcattccatttgattatattccattcatgtccattccactgcatttcattctgttccattccagtccattccattccattccattccagtccagtccattcgagtccattcctttccctccgttcgagtccattccattgctttcgtgttcatctcattcgattccattccattccactccattcctttcaattccattcccttctattcctttcaaatccattccattccattacattctagtccactccattccattccattctattccatttgagtccattccattccattcgagtaaattacattccattcgattccattccatttcattccattccagtccattccattcaattctgttcaatttgattccattacattccattccattcgattccattacattcctttccattcgagtccattccattctattctcttccatttgagtccattccattccattccattccattccaacccatgtcatttgagtccactccattctattccgtttgaatccaatccatccaattccattccattcttgcaaatgccactgcattccattccattcgagtccattccattccattgcattccatttgggtccattccattcaattccatttgagtcaactccattccattgcattcgagtccattgcattgcattcccaaccattcgaatccattccattccattgcattcgagtccattgcattgcattcccaaccattcgaatccattccattcccttccattcgagtccagtccattgcattccattccattctttttgagtccattcaatttcaatccattcccttcgagtccattccattccacccaattcgagtccattccataacattccattcgagtccattccacaatattacatttgagtccattccattccattccattagagtgaattccattaaaatccattgtattccattcgagtgcattttacattccattctattagagtccattctgttaaattccattccattcctttcgagtccattccattccattccattccattccattgcattccattccattcctgtccattccattaaattccattctagtcccttccattcaaatccattccattccagttcgttacattctgttgccttcgagtcctttccattccattccattccattccgttccttttgggtacattccattcaattccaatcgagtccattccatgtcattccattctcttcgagtccattccactccgttccattctattcaattcaagtccattccattccatttccttccattccattcaattccattccattccattagggtccattcctttccattccattcaattccattccaatgcattcgagtccattccattcgagtccattccattacacatcatttcatttgattccattccattccattcgagtccactcctttccattcaattctagtacattctagcacattccattccatttgagtccattctattccatttcattccatgcgattccattgcattgcattccattccagtcctttccattccattctattccatttgtgcccattctattccattccattcgagtccattccattccaaaacatttcattagagtgcatttcattccattccagttctttccattccattctattccatttgtgtccattctattccattccactcgagtccattccattccaaaacatttcattcgagtacattccattccattccgttcgaaaccattccatttcattcgattccattcaagtccattcaactccattccattctattccactccattccattacattcgagtccattccattccattccaatccattcgagtccctaccattccattcgattgcattccaatccattcaagtaaattctgctccattccattctgatcgagaccattccattccattcgagtccattccattccattcgagtccattccattgctttccatgccattccattccattgaattcatttccattccattccattccattcaggtccattccattgaattccattcgagtcctttccattccatttgagtaaattccattccatttcattcgagtccatttcattccattcctttcctttcgagtccattgcattccattcaattccattccattccattccattccattccattctattccattctggtaaattccattccattccactcgattccgttacattgcattccattcattcgagtccattccattccattccattcaactcgagtcaaatccatttcattccattccattcgagttcattccattcaattcgaatccattctattgcattccattccatttgattctattccattctatacctttcgagtcctttcccttccattccattaggtccattgcattaaattccactctattccaatcgagtacgttccattccattccatttcattcgtgtccattccattgcattcgagtccattccattccattccattctagtcgatttcattctactcatttccattcgagtccatccctttccattccattcgagtccatgtactttcattccattccattcgaatccattccattgcattccattccattcgagtccattaaattccattccattcgagtccattcaattctataccaatggagatcattctttccaatccattcgtgtcctttccaatccattgcattccatttgagtccattccattccattccattgtattccattaaattccattcaattcgacaccattccattgcattcctttccattcgtgtccactcctttccattccattcctttccattcaagtccattgcattccattccattccactcaagtcctttgcattcagttgcattcgagtccattccattccattccattcgagtccattccattccattcgagtccattcctttccatccaagtccattccattccattcaagtacattcaaatccattcctttccattcaagtacatacaattccattcctttccatttgactcctttcctttcaaatccaattgagtccattcctttccattcaagtccattccattccattcaagtccattctcctccattccattctactagagtccattccattccattccaatccattccattccatcccattcgtgtccattccattccatttcattccattccattccattccattcaaatccattccattcgtgtccattccattccattcttttccattccattccattcctttccattccatttgagtccattcctttccattccattccacttgagtcctttctattccattccatttcattccactctagtccatgtcattccattccattccacttgagtcctttctattccattccatttcattccactctagtccattccattccattccatttcgttccattccattccattccattccattcgagtccattgctttccattctattccattactttccattcgaatccattccattccattccactctagtccatagtattccagtccattcgagtccattccattccattctggtccattccattcaattccattcgagttaattccaatcctttggagtccattccattgcatttcattgcattcctttcgataccattcaattccattccattccattcgagtccattccataccattacattcgagaacattcctttgcattccactccattagagtccattgaattctattccatttgaatccattccattccattcctttagattccattccattagtgtccattccattaaattccattccatcctattcgagtccattccattccatttctgttcattccattccattaccttcaagtccattccattaaattccattctctaccattcaagtccattccagtccattacattccattcaggtccattccattccattgcaatctattctatttgattccagtccattccatttgagaaaattccattccattccattccatttgagtcccttccattccattccattcgagtccatgccattccattccattccattcgagtccattccattccattccatccattccattcgtatccattccattccattccattccatccgggtccattcagttccattgcattttggtccattccattccattcgagtccattacattccattcaattcgagtggattcccttccattccattccattcgagtcccttccattccattcaagtccattcctttccattcaattccatttgactccattccattccaatccattcgagtccattcctttacatttgtgtccattcctttccatttgattccattccactccattccattctaatagattccattctatttcattctaatccattcctttccattcaattccattccattccattccattccattcgagtccattcctttccattccattccacttgagtcctttgtattccattccattacattccattcgaatccatgccattccattccattccattccattccattctatcccattccattccattcgagtccattccgttccattcccttccattacattcctttggaatccattccattgcattccattcaagtcaaatccgtagcattccattccattcgagtccattccattccaatccattccattccggtccattccattcaattccattctagtcaacaccatgccaatcctttggagtccattccgttgcatttcattccattcctttcgagaccattcaattccattccattccattcgagtccattcaattccattacatttgaaaccattctttgcattccactccattagggtttgttgaattcttttccatttgaatccattccattccattccattccattccattccattccattattgtccgttccattaaattccattccattctatttgggtccattcctatccatttgtgttcatttcattccattccattccattaaattcgagtccattccattccattcaagtcgtttccattcctttcgagtccattccattccattccactccattcgagtccattccatttcaatccattccactcatctccattgcattccattgcattctctttttgtagaatttgtaagtggagatttgaagagctttgagacttatggcagaatagtgaatatcttcgtgtaaaaaccagacagaatcattctcagaaactgctttgtgctgtgtgtgttcaactcacagagtttaacctttcttttgatatagccactttgagccaccgtttgtaaagtctgcaagtgtatatttggacctctttgaggccttcgttggaaacgggatttcttcatgtaaaactagacagaagaattctgagaaacttctttgtgatgtgtgcattgaactcacagtgttgaacattcctttcgatagaacagttttgacacattctttttgtagaatttccaggtgcgtatttagagtgctttgaagcctatggtagaaaacgaaatatcttcatataaaaactagacagaatcattctcagaaaccgctttgcgatgtgtgcatccaactcacaaagtttaacctttcttttgatagagcagtttagaaacactctttttgtagaatttgcaagtggatatttaaagcactttgaggcctatggtagaaaaggaaatatcttcatataaaaactagacggattcattctcagaaactactttgtgatgtggacgttcaactcacagaatttaacctttcttttgatagaacagttatgaagcactctgtttctaaagtctgcaagtggatatttggacctctttgaggccttcgttggaaacgggaatttttcatataaaacaagacagaagtattctgagaaacttctttgggatgtgtgcattcaactcacagagttgaaccttactttcgaaaaagcagttttgaaacaccctttttgtagaacttccaagtgtatacttagagtgctttgaagcctatggtagaaaacgaaatatcttcgtataaaaactagacagaatcactctcagaaaccacgttgtgatgtgtgcgttcaactcacagagtttaacctttcttttgatagagcagttatgaaacactttttttgtagaatttgcaagggtgtatatagagggctttgtggcctatggtagaaaaggaaatatcttaccataaaaactagacagaagcgttctcagaaacgaatttgtgatgtttgcattcaactcacagagtttaacctttcttttgacagagcagatatgaaacactctttttgtagaatttgcaagtgtgtatttagagggctttgggtcacccaggctggagtgcaggggcgcaattttggctcactgcaagatccgcctcctgggttcacacattcccctgcctcagcctcccaagtagctgggactacaggcgtccgccatgacgcctggttaattttttgtattttttagtagagatgggctttcaccatgttagccaagatggtctcgatctcctgaccttgtgatccacccgccttggcctcccaaagtgctggcattacaggcgtgagacacctcgcctggcccaactttactctttattctcaaacttacaaccatcagatactcatgtacacagaataagaaaaatcaactttttttccttgaaggcaatgtttcgtcttgtattttataatatctgttccacattgctgtgacaatgctgttgaagtgcaccttccttccttcaccaaaagatcacctgtgtgaatttgaatagatggtcactggaggggaccagcgtggcacactgggttgaattgtctctttgcttttcaggcaaagtggctttgaaaagactgaaaataaagtgactgctgattaagcagatggcttgccatgtaaataggacaattgtttgaaaatcacatcgcatgaactacaactattaaagtgtgaaatgcatgacgcaaatattgcacaaaaaaataaaatgaaaatgatgaatacagtcaaaaaagacagccaaactccattttagcaataaagtaaaatataatctactgtcaggggaaggtaacttgaagtacttgagatgttctttaatttaaaaatccaaaaatatttttagctttagttactataaaaaatgtttaagcattttccatttgaaataaaatttcaatttcatgctttgtcagtttagtttccctaaataaatagaaaagagtaaaatatcacatacaaaaaaaatcaacttctttggtaataaatcagttcaactgtcagaccaaaacataattacattttacccaatgtcgtgctgaccaatttgatcaaatgccacttccttatcactaagagagatgcaaagatgtagactttatgttgagtgagacaggtaaggattactaggagctagatagttgttttactaatcaaggtcgattttcattactattttgtctctatgttaattaatggtcttgattcaagaaaatttttttaaaaactcatcttctcagtcaggcaaaatattaacaaaaaggcatagaaatgaaggcatttaacacagtcatagtttacattttaaaattaaaatacttctagaaataacaaaaaaagaaaaaagacagatgtaaaaaaaaatgaacttaatttttggtgcaaagcactcattactaagcctaacacaaatattttggtaaaggctttctaacactgacattcttctcatgacttaaaagcgccactaattttacttttgacatatatttagttttaatattaaaagctaaaaggagcctattattttatttataatttgtggtctgcatgtacatcatcatccactgagtcgactaaagtttctgaaagtttcagaaacagtaacataagaatactttttcctgccatgcacggtggctcacgcctgtaatcccagcactttgggaggctgaggttgggggatcaccttaagtcaggcattcgagactagcctaataaacctggtgaaaccccatctctactaaaaatataaaattaacggcatggtggcacatgcctgtaatcccagctacccctttaatgaccacatgtgaagtttcttttgaactaattttaactacctatttttattgcttttttttggtcctattagaaaaacattaaagttcctgttactacaaacacaatctattcaaatctaagcatactgcttatcttaaaagatctgtaggcttggaattatggaaatcctattctccatttaaaatactgcttttcagtaagccaaagggggcaattgtggctcataatcatgttattaaatattaataccatcatctagatggaacttttagttatctgcatgttcaaattgttttcacttataataagtcagaaactataaaattttataaactataaaaataaactaaaaatatatttatcaatgcattttttttcagttttaaaatacttagcctcaggattatttctagttgacataacactagatttcagatgatgtggatgtagaaactagaaacatcctagttgactcatcttcactttctgccttcatttagcacacaaacatagcagcaccaacaaaggccagcaatgctaccccttttgaaaaacacaccagtgcccttctagggagaatatatgtgtgaaaagattcatctgaaagtcatgccatcttctttttgatttacagacttatatatgacaaataatacaaataaaaatttaacagtgccatataatcagaaaattattctaaaaattccttctgacacattattctttttcaccaaaatggctgtgatgaaatgattgcctttgcaggactgttgtcttaaataaccaatactcccgtttcattgttcttgaactttaaccataacgctttcatgctttttctagaaattttatttcctaattatgtcacttaggtataattaccatagcttcatattttcaaaagtggttctaaaaaaacttaaaccactgaccatctttttttcccaaaggagtagagtaataaataaacactatcacctagtgcactgtaaatagatgaaaaataaagatgtagagctggggtgtccaatcttttggcttccctgggacacactagaagagttgtcttgagccatacataaaatacaccaatgatgatttaaaaaatcacaaaaaactcataatgcttttagaaagtttctgatttgtttagggctgcactgaaagccatattgggccacatggagcgtaggccatgagttggacaagcttgatgtacagtcatttattttagctgcacactcaaaactaaggccgagagctttcagagaaaatagcttataggatgtcaggagacctgttatagaaacattcacccctatgtctaaaggggacaaaattctatgtcttccacccttaattccaaccattaaccaaaactggagaaatctaacatggcattatatcacaaagtattttattatttgtattttggattcaaggatacacgtgcagatttgtaacataggtatactgcatgacgttgaggtttaggcaattaataatcccattgcccaagtagtgtacattatacatgacaagtactttttaacccttgtaccccttctccctccattttcgaatccttagtgtttatttttctcatctttgcttccatgtgtacccaatgtttagcttccacttataagtgagaaaatgtagtatttggttttctgttctgtgttaatttgcttaggatcatgaccttgagctgcatccatgttgctgcaaagagtattacatgattcttcttcagtggctgcatagtattggatggtgtgtaattacctaatttttaaaatccatcttaagatttatgagcacatggtttcattccatgtctttactattgtgactagtgctgcaataaacatacgagtgcaggtgtatttttggtagaataatttatttgtattgtattgaggtatatgcccagtactgaagctgctgggtcaaatggtaactttagttttagtcctttgagaaatccccaaaatgcattctacaggaggtgaactaacttgcattcccactaagagtatatcagggttctcttttctacataattttaacttttttttttttactttttaataatagccatttagactggggtgagatggtatcacattgtggtttggatttacatctctctaatcattagaaatgttgatcaatttttcatatgtttgttggctgctttttttgtctttcttttaaaagtatatgttcacatttttgtcaacattttttcttaaattccttataaaatgtatatattagttatttattgtatgcagtttacacgtattttagcccatactgtacgttgtctgtttattttgttaatagtttctcttgctgtacaggtcacaatttttaatttttatttttgttgctttcacttttgaggatgtagtcattaattctttacagagaccaacgccaaggagagaattttctaggtgttcttctaggacttttataggttgaacacttacagataagtctttaatgtatcttgatttaattttctgtatcatgagaagtaggtgttgcgatttcctcttctgcatatgactaaccagtttttccagcacctttttttgggtagggagttctttccatttgtttttgttgatgctgtcaaaaatcaattaattttaagagttcagcttcatttcagtgctctcttctgttccgtaagggtgtgtgtgtgtgtgtgtgtgtgtgtgtgtgtgtgtgtgtgtgtgtgtatctgcatccatattatattggttaccgtagcttgtggtaaagtttgaagtttggtaacataatgtcaccaggtttattctttttgtttagtatagccttggctatttgagcttttttgttttcatataaattttagaatagttttttgactaattttatttaaaaatggcattggtagagtgatagaaatagaaataaactgttgattgttttgggcagtatgaactttttaataattctaatccattagcatgaaatactattccacttacttgcactgtgtctgatttctttcagtagtggtttgtagttcttctagtagagatatttaacctcctttgtttaatggatcactattttattttttgtttctggctattgtaaactagattgtgttcttaattttgctctgtttaagtgttactggtgtatagaaatgttcctcatttttgaatgttgttttgctttttgttgttgttgccctgagattttgcagaagtcttttattaggcttaagagtcttttggaggagtctttgaagtaggtagacagttatatcatcagtaaagacagataagttgacttcctcttttcttatttgagtgtttttctttctttatcttgcctgattgttctggctaaaaccttcagaactatgttgaataggagtggtgaaagtgcacattcttttcttatttcaatttttaggaaagatgcattaatctttcacctgttcagtatgatgttggctgaggatttgtcttatatggctgttattattttgaggtatgttccttcaatgcctagttttttgagaatttttttcataaatagatattacattttattaattgctatttccacatctattgagataatgtggttttgttttttaattatttttatatgttgaatcgcatttatagattgcacgttaaaacattcctgcattcacagaataatgtccacatagttgcagtgaaataactttgatttcctgactcagtttgcaagcatttcatgaataatttttgggtctgtattcatcagggacattggcctgtaattttttttgttgtgtctttactaggttaatatatcaagatgacagtgatattatatgatagaattaattaggatggagtcccactttgattttttggaataatttctgtagaattacagccaactcatttttgtatatgtgataaaatcatgctatgaatgcatctggtttagtactttttataattggtagattttttttatcaccaattcaatttacttacacatttttggtttcttgaagacttctgtttattcctgattcaatcttgggaggttgtatgtttctaagagtttattcatttcctctagattttctagttggtgtgcacacagatatttatagtagtctgcaagcatcttttgtatttttgtgggattggctgtcacaactgtaacattcaaatagatgcataatgaaagtgtaacaaaattcaatatctcctcataataaatctcttgaactagttataaaataaatgcaattcaaggtaatgtcattaacaacaatgcacacctaacaacatactaaataaggaaaaactgtaagccttttctctaagagctagaacaagacaaggatgtccaatttctccaatctttttttttttttttttttttgagatggagtcttgctctgttgcctaggctggagtgcagtggtgcaatcttggctcactgcaagctctgcctcccagtttcacaccattcttctgcctcagcctcctgagtagctgggactacaggtgcgtgccaccacgcctgcctaatttttgtatttttagtagagacggggtttcaccttgttagccagaatggtcttgatctcctgacctcgtgatccccccacctccgcctcccacagtgctgggattacaggtgtgagccgccacgcctggcccaatttcttcgatcttactgaacataatacaaaatgaccaagacagaaaaaatattcaataaaatcaaagcaatcttaaataaaatgaagaagataaattatagtttccttgcagatgatataatcttaagtatagaaaaacctaggacctcacaaaaaattattagaatatacaaatttattaaacttgcaggatccaaaatcaacataaaaaaattccgtaatatttctatatactaacaataaagtatctgaaaataaaaccaaaaaacaatcctatctacaataattgcagcagtaactatacttagaaatgaatgtaaccaaaaaggtgaacgatcggtacattataatctaaaaaaaaaagaatttagaaaataaataatattcaaacaaaaagatatttctaattcataaatgggcacgattaatattgttaaataactgcattacacaaactgatatacagatataataaaacttctattaaaatccagttaaattctccatagaagtgtttttaaaaaatctaaaatgtatattgccccacaaaagaccttgaatagctaagaaaatcaagcaaaaaatgaaaaataaaaggctgaaggaatcactctgacttttaaatgtccaacaaagctacagtaatcaaaacagagtgttacttgcataaaaatggacacataggccaatagagcaaaagagaaagaccagaaataaattcatgtatttacagacaactgattgtaaataaagatgacaatttaaaaaaaaagtcttttataaacgatgttgagaaaatatatatccacatgcaaaataataaaatcagaccttcatctcacaccatatataaaaattaactcaaattagatacttaaatgtgagacctgaaaatctaaaactaagatgaggaaatatagaatgaatgccccataacattggtctgggcagtgactcttgggtttaacctcaaaattttagggggaaatagacaaaccagatttcttaaaattaagaagctgctgcacaccaacagatacaatcagcagaatgacataactgaaaaatggaagaaaatatttgcaaattatacatgtgaaaagcagttaatatcaaaaatacataagaaactcaaaggactataaaacaaaaaacaaataaccattaaaaataagcaaaagatctatataaataattttcaaagaaagacatacttatagcttggcagatagatgaatatggctcagtcaattatcatcaaggaaaggcaaaccaaaacaactctaagatataaactcactcctgttagaatgtttaaaaaaaattgttggtaaacttgaaaaaagagaaagaggaaagctttcacactgtttgtgtcaatgtaaataaaaacagccattatgaaaaatagaaattttgcaaaacaattaaaatctaacatgtaattgaactactggatatctatcacaaaacaaatgaaactagattgatgaacagacatctgcaattctgtttgttgcagcacactttacagaagccaaaatatagaatcaacgtatgtgtccatcgtccaatgaggaaatacacacactatggtgtatatatacaatggaatactatattttaaacaaaaaatcttatttttaatcacaaagataagcctaaaggacactatagttgttgaaataaggcacagaaaggttaatatctcatgatttcactcacatgtggattctacaaaacatatattgattacataattacagttggataagaaaaataagttcaagagattataatgcatgtattgtgtttctgaaaaaatgctaagacagtaaatgttgtcttcgcaccaaaaagtaactatgtgaggcaaagcacttgacaattacctaaaattaggcattgacaatgtatatttacttcaaaatactattttacaaaataaatacatattttatcagtgaatttaaaaatatatttataaaaactattaaaaatgacaaaggttcaaattctgactctgtgtttttgtcataaacctgtctgaatagtatgaaagatacatagtttttgtgctgttttttcacctagtcagtcatgaccatatgaactctaatatttaccaccatgtttttgggacccagcacagaatatgggagaagccaacgtaccttaggccttttactttgagcttgggacacctggagtttctggtgctggtggtaatgatagggaagacacaaaaagggcaggtgttgctgtggttcacatgattaaaccactctgaagagagtaaataagtttgcatcccagatcactgaagaaattttttaactcaaaagatgacatgatccttaaaatttttccagataaaatgaccaaggagttgactagttaggtgacaaagaatgaaacctctaaattgtaaactgcacccaataaaaaagtacattatacaagtgtgagaaattcctcaagattttaatgttaatatgaaaaagattacttcacatgtgaaatccacaggtgtcattctattatttttgaatatttaacattcacaccaaaataaaagattctgaatgaaaacttaagttgagctgtaagtatgtaataaaaaatttaacattctccacttaccattaactcttctaaaagtttaatttctaagacatatcttctaactaattttatattttccacacattgtgttaattttgtttttttttgagatgaagtctcgctctgtcatcaggctggaatgcagtggtgcgatctcagctcactgcaacctctgcctcctgggttcaagcgattctcctgcctcagcctcctgaatggctaggtcaacaggtgcatgccaccatgcccagctaatttttgtatttttagtagagatggggtttcaccatattggccaggaaggtctcaatctcttgacttagtgattctcccacctcagcctcccaaagtgctgggattacaggcgtgagccaccacacacagactgtgttaaaatttaataaaagtttggttttacaaagacaagaaattctgactgatttattcctctcacctgtgaacaccggatgccttttatctcaattaacggatctgaaagttacattgacaaacttctcatcagaacctacaaagtactgtgtgaaatgacatggcacaaaacaaacagcaataaaaatgtagccataacacaaagaagaaaaagaagggctgtgatgcatacacagttgggataaacataagtagacacaaaaacaaaactaaagataatcagaaaataagaagaatgtctctttaaattcagaaagagtcagttttgcagcataagaacaacgtcctctccacatacagaatcgattttatttcttcaccacgcatatttctttatctttacttggagctacaaactaactccagcagaaatatttatggccaataatggtgcctctattacagcaagcattgtgtttgctacatttacatatcaaaatatctttgtgacttatgaagcctccccagtatttacttaaacaaattggctgaatgaataaattcacctatgtcaattataaagagtaaaaggaacaataaggaaacttagcttacacaggtttctccaattaaaataacaaaatgggatgttctaactaaatgaaatataagttggtcagatgcagtggctcacgcctgtaatcccagcaccttgggaggatgaggtgtgtggaccacgaggtcaggagttcaaggccactctggccagtatagtgaaacacagtctctactaaaaatacaaaaacattagctgggcatggtggcacatgcctgtagtcccagctacttaggaggctgaggctagagaattgcttgaacccagcaggtggagggtgtagtgagctgagatcccaccattgcactctagcctgggtgacagagcaagacaccatctcaaaaaaaaaaaaaagaaaaaagaaagcaacaaaagaaatataagttaatacactcattgtgaaataacattgaaaaattattttgcatgcattactaaattttataaaaattcttagaatatctgagcaactcacataatgaatacttaataaattataaacacaaaaaatatgaaaaaaaaaatcagtctaccatgagtaccaggcaaatgaaagaaagaatttgcatggaaagattcggaaacacagtccataagacttcacagtaattaattaaataaaatgcagagaatacagatattattcaaaatcactgaggtttctggttttctagtaaatgatttgtccactttattaaagtgatattttgttccaatattgcttgtcttctgaaaataggtactctcacacacaattacttgccccacaattttcttacacctaatgtttatcttaagagtaatatatttgtatatttagcatcatgtaagtaaaaactaacagtctgcatgagtttacaggcagagagtccacttgttcaaaatatatatgacaaatttttaaaaatattcattcaggacttagaaatgtgagatttattatactactatgtaattattatcaagacgataaaaaacctctgtagcaagtaataatttacttgtacatttttagataactaaaaatgtttaaatggattgtctgtaatacaaaaaaaatgcattaggtaatgaatacctcatttactctgatgtgattacaaattgtatgcctgtatgaaaatattctatatatgccataaataggtaaacaatattatgttcctacaaaaatttaaaaagttaaacaaatgtacattttacccattgaaacaatactgttaaacttttcagtttaatgccacaggcaaaagagattgctagagaggtcattctactatgttaccatcttttatctacatctttaatacagtgggatacgttaaagttggtgacataacactttactaaatgcacgtcttaaaaagtttaaaaccatttcgtttaatttaaaagttaagttatcacagtcttataaaagaattttaaaattccctacattttattacataaaagtacaattggtaaaacaatttactactaaaactcaaagttttcctctcactataatgcagaatattactctaaacacataactcatgcatcacatgaacaatgttaaaagtcagccataaagagcctctccaatcagattttcattatcatcttacattttaatatccttactcttccatggaaaaattaatgaatgatgcctacctaataagaaaggaatctctcagatttctgatgcaacagaaattgatgacatgcttttacacaaacaacaggaaaaaaggaacagcatgaagcaattttacagttgaattacctacttgcttttcaaaaaacttacacttttttcaaggaaaaacgtataccttgaatgtaattttaactctccaaaaaataaccttccactcctcttaaacttatatacaaataaattatccaacagttttagctttggattactttctttacagaacattctgatttagtgtaacgtcttaagtgccagtgccttagttctccctaccgtgaattttctaaagtttacaaagacttaattttgactaaatatttttacatatgtattccatctgcaaaaatattttttattataaactgtgtggtgttttgtaagctgtagtttctgaacaaatgtttttccacacttattacatttgtacggtttccttcaacataaattctctgatgccaaacaagtttgagtaattcctttagagttttcttctagtgtaaaatctgtacattatatagggcaagtaaaggtattacaaccctctttatatttgtaatgtttgtctccagaatactcttttttattttaagggtttatattttccaaggtctttgaacagtaattacatttataataattttattaagtatgaacttcctgatgttgactatgatgtgagcagatagaaatggcttttccacactctgtataatttttcaagtataaacgcttttatgtgccataaagtatgagcatgttagaagttttgacacattctttgtttgtagagattttctccactatcaattattttacctacagtaagatgtgacaaccatttaaagggcttgccacattgttcagttttctgaggtttctcactgatatttctccaaggcttaggaaagtttgaggtgtattcataagctttgccaaacttccttaggttcataggcataatctttagtatgaattatggctggatatatttgagcaatacttaaaagattttgccacagtcttccaatttgtatgatttttttccagtatgaattctcataagtttagtaaggcttaaggactggttaaaggctttcccacattctttacatttgtgggatttctcttcagtatgaactctcttatgttgagtaaacttgaggaacaagaaaaagttttgccacattcttgacatttgtagggtatctctccaatatgaactctcttatgtttagtaaagcttaaagaccagtaaaaggttttgcaacattcttcacatttctggattcctctccagtatgaattctcttatgtatagtaaggcctgaagactgcttaaaaagctttgccgcatgcttcacatttgtagggtttctctccagtatgatttctcttatgttcattcggttttgaggagtgtttaaagactctgatacattcttcacatttacagggtttctcttcagtatgaattctctgatgtatagtaagttcagaggaccacttaaaagctttgccacattcttcacatttgtatggtttctcttcagtatgaactatcttatgcttagtaaggcttgaggaacagtaaaagcctttgccacattcttcacatttgtaagattcctctccactatgagttatcttatgttcattcaggtttgaggattgtttaaagcctttgccacattcttcacatttgtaggattcctctccactatgagttatcttacgttcattcaggtttgaggattgtttaaagactgccacattcttcatatctgtagggtttctctccactatgaattatcttatgtacattaaggtctaaagacttcttaaaagctttgccacattcttgacatttgtagtgtttctcttcagtatgaactatgttatgttgaataaggtgtgaggaacagtaaaaggctttgccacatttttcacaattgtagggtttctctccagtatgaattctcttatgtatagtaaggtttgaagacgcttaaaagctttgacgtattcttgacatttgtagtgcttctctccagtatgaactatcttacgtttagtaaagcttaaggaccagtaaaaggctttatcacattcttcacatttgtagggtttctcttcattatgaattctcttttgtatagtaaggcccaaagactgcttacaagctttgccacattcttcacatttgcagggtttctctcccgtatgaattctcttgtgtatagtaaggtttgaagaccacttaaaagctttgccacattcttgacatttgtagggtttctctcccctatcaattatgtttagtaaagcttaacaaccaataaaaggctttaccacattcttcgaatttgtaagggttctctccagtatgaattctcttatgtagagtaaggcctgaaggttgcttaaaagctttgctacattcttcgcatttgtaggatttctctccagtatgagttctcatatgttcattcagttttgaggattgtttaaaggctttgccacattcttcacatttctagggtttctctccactatgaattctctgatgtatagtaaggtctgaaaaccacttaaaaattttgccacaatctttatatttgtagggtttgtctccagtatgaactatgttatgttgagtaaggcctgaggaacagtaaaaagctttgccacattcttcatatttatagggtttctctcaagtatgaattcttttatgttctttcagttttgaggatattctaaaggctttgccacattcatcacatttgtagggtttctctcccatatgaataatcttacgcatagtcaggtttgaagactacttcaaagctttgccacagtcttcacatttgtagggtttgtcttcagtatgaactatgttatgttgagtaacggttgaggaataggaaaaggctttgccacattcttcacatttgtaggttgtatctccagtataaattttcttatgtttattcagttttgaagattgtttaaaggctttgtcacattcttcacacttgtagggtctctctttagtatgaattctctcatgtatagtaagacctgaagactgcttaaaatctttgccacattcttcatgttggtagggtttctcttcagtatgaattatctcatgttgtcttaggtgtgagaacctgtgaaagaattggccacattctttacatttgaaaggtttctctccagtatgtcttctcctaagtctatttgaatttgaaaatttcctaaagactttcacacatgtattacattgaagtattttgctctgagtaaccgacaaacattggttaagtccattataacctccttcctgcaacttagatgcattcaaacttttacagccttttcttatttgtaaattctcatgtctagatttctcatatcttctcagtatcactttttgaaatgaattttttatgttctgatctagccaaaggtcttgggtgaaatgagaacacagctgaaagaaataaaaataaattatctcagtaggcccatgtgaatatacaaatctattgtttacaaatctaatacataaaattatacaaagtacattagcaacatggcataacaaaaataccacaggtcctaattcttttatagagttataacaaaactctactgaccaaaatgtccttatggaaaatctagaaatgagttaagtgtgttcagtgtaccaggtgagcaaaatgccacaagccatactgaatggatagaaaagtttgttacatttgcccaacacctttcctcctccataatgcagcatggcacttttagaagtaaactgcaatgtctggcatcttcctcaatatagaaaaaaaaaaaaactggctcatgtatttttacttctggcttctggacacttttacagagacttgtttctgtctccaatgacaaaatgtgctgaaagaaattatggtatactttgaaataacagcttgagtctgctgagaccaaaggtaaatgttacagcaaccaactacagtaccacagacatgaaatatgtataggaagtaattacagactgtttaagaaacacaggcaaacccctttaactgagtaatcaacacaaaattccacacatgacaaatcataacatatttgataggctcccagaatctctagttgagacacttggtttcagactatgttaggacaacaccgcattataaagattgtgacacatagctgtttgttaatgtccaaatctcaaccaaagagtacaatacatacaaaatattacagtgacatggcctaagtaaaaaaaaaaacttaaaactgtcagaaaacaaccatgaaaataaagatgtacacattagttttaaaaatttaacctaaatgggaacacaggtaactaaataaaatcagaaaaaaacagactatcaaggaaaagatgaaaaatataatagaaattatggaagtagaaaatacagatagaaataatgactgaggccaggtgtggtggctcatgtctgtagtcccagcactttgggagtttgaggcaggcagatcacttgaacctagggagttcaagtttaaacagggaaacatggcaatacttctcctctataaaaattaaaattagtcaggtgtattggcacacacctgtggtaccagtaaacaggaggctgaggtaggaggatcacgtaagcctagggaatccaaggctgcagtaagctgcaatcatgccactgtactcaaacctgggtgacagagcaagacactgtctcaaaaagttaagaatacctgagaaattctcaaaagtaagaaaataaggttgtaaaaatgaagaagctcaacatactaaaactaggaaacacacagatccataacaagacatgcaaagcaaagttcccaaaatcacagacaaaaagagaatctcgaatgctggaaaatacataattatggttctatgatataaccagtgactctttcaacaaaaaccttgcaggctagaaggaaattatgtgctatagtcaaagccaagtgaaaaatagcttctgtgtaagaataatataaccagaaaaactgtgctacaaaatgaagaaaaagtaaagacctctgaagataaccaaatgtggaaaaattatatcaacactacatacgccctacaaaaaatgctgagaagagtcctactactaaaattatatgatgctaaaaaacaaaactatcatataaaaatagatagctttctgggaaaaatataaagatatgcaaatattatacaaaaaaatcctgtagcattatcataataccaaaaaatgttttatttaattattctctaaaatttaaagataaaagctaaaaataataatgaacatctggtataaatatataacataaatagatatgtttagtgacatcaataactaagttgaggacagatgtaataagaaataatttgtgcatgaacccgaatttaaatttcaccacttcaaaatatattgttgaaattttaagagatttttatataatcctgaaggcacccacaaagaaaatgtctgtatagatacaaaaaaggaagtaagaaagaagtgacagcctatccatacaaaaatcaaaaagacacaaaggaagatagaatgagaaacagacatgcaagaatcattaaacaataaaataacaataatctttgtcttcagaaaataaatattttaaaaacagactttccaatcaatacacatatattgaatagagggattatataaaattttatgtaccaagatccaacttgcctttcttcaagagtcacttgagatctagtagtgaaatcggcctgaaagtggcaagtggaagaagacatttcaggcaaacattaaccaaatgtgaggagaagacatcaaaattgtattatacaaaatacatcgtaagtaaacaactctcttattttataaaatatactttatgtcaaaattcacaagagaaaaaaggtcattaaacaataataaagacatcatttattgaaaacgtatgacaaatatgtgcatacatatatttatatgtttgtgtgtgtatgtgtatttctcacattaggtttccaaaaatacaaatcaaaaattgacagaattaaagcaacaaatagagagaaatataattataataagatattttaatacttcaatttctgcaatgaacaataaaacaaaacaatattaataatagaaaagagggccaggtacggtggctcatgcctgtaatcccagcactttgggaggccgaggcaggccatcatggggtcaggagatcaagaccatcctggctaacacaatgaaacccagtctctactaaaaatacaaaaaattagcagggcgtggtggtaggtgcctgtaatctcaggtactcaggaggctgaggcaggagaatggcatgaacccaggaggcggagcttgcagtgagacgagatcgcaccactgcactccagcctgggcgagagcgagactctgtccccaaaaaaaaaaaaaaaaaaaaaaaaggaaaagagaaactgaaagcagtacagatggggacaagtggctcatgcttgtaattctaacactttgggaggccagggaggacagatcacctgaggtaaggagtttaagaccagcctggccaacatggcgaaaccccatccctactaaaaccccatctctactaaaaatagccatgtacagtagcaggcgcctgtaattccagctactcaggaggctaaggcaggagaattgcttgaaccagggaggcggggtttgcaatgagtcgagattgcggcactgcagtccagcctcggtgacagaccaagactctatctcaaaaagaaaaaaaataccaagaaagcagtataaaacaatattatgcctaacaaagaacaccccttaataatagcagggtacaaccattctcaatagctcacatacattctctttgaaaaactgcctgttagtccattataaaaaaaaaacttactaaatctttaaaaattgaaattgatagattactttttatgaccaaaatggaatgagagtagaaatcaacaaaaacaaaactaaaaaatttataaatacatgaaaattaaacaacacactcttcagcatgctcaaagggtaaaataattaatattcagcatgatcaaagggtaaaataattaatattgtgaagatgcccatactgctcagtgtaatctacagatttaatgcaatccctttcaaatatctaattttattttagcagaaatagaaaaagcaaccccaaaattacatgaaattttaagaaacaatgaaacacccaataatcttcaaagagaggaacaacgttggaggcatcacaactccctgatttcaaaacacattatacagacttaaaacaatttggtttggttataaaaagtgaactagaccaaataaacagaatgtagtataaactctcacacatatactcataggaagagttatttgcacatccataattttttttttttagatggaatctcactctgttgcccaggctggagtgcagtggcacaatctaggctcactgcaacctccacctcccaggttcatgccattctcctgcctcagcctcccaagaagctgcgactgtaggcgcccaccaccacgcccggctaatttttttgtatttttagtggagacggggtttcactgtgttagccaggatggtctcgatctcctgacttcatgatccgcccaccttggcctcccaaagtgctggtattacaggcgtgagccaccgcacccggctgcacatccataatttttacagcattgttattgacaggcaataggtgaaagcaatgcaaatttttctccccagattactggataaatataatttgaaacataaaaataatggaatattactcagtgtttaaaaacaggaaatacaggccgggcacactgcctcacacctgtaatcccagcagtttgggaggccaaggtgggttaatcaactgaatttgggagtttgagaccagcctgaacaacatagaaaaaccctgcctctactaaaatacaaaaattagccaggcatggtggtgcatgtctgtaaccccagcctcctctcaggaggctgaggaaggagaatggcttggaatttgggaggcggagattgcggtgagctgagatcactgcactgcactccagcctgggcaacaagggcgaaactccatctaaaaaaagaaaggaaatattctaacaaccataataaactttcattaaattatgcaaaatagcatatgtcagccacaaaaaaatgctgtatgaatccacttacatgagatatttaaagcagttagactcaaaaacaggaaaatagaattgtttgtaaagggccagaaaatgggagaaatgagtagttgtttaatgtgtattcagttttagttttgcaagacaaaaacattctagagatatgttgtataataatgtcaatataattaatataaactacatatttttaaattaagattctaaattttatgttcttgataattaaaaataaacagtaataatacctaaaaatgggacaaaattgacagtttttaaaattaccttcaaatcaaaaaagtatttctcccacacaaaaatagattcccaaatagatattagaagtaggagaatttttatgactactcagataaaacgaccattgatcactcacaaacatacaagtcataagcaatatagaaataatatgcgtatacacaaacacagaaattattatattgggaatagacatatgactgattcatatttaactttggctccacgctgtcttaaagtgcacagagttgaatattgacattcacaattaccatacaaagtaaaaactaaaaacacaattaactgatgtgaggtggcatactctaaaatatgaaacaaaaaaaaataaaattggctgggcatggtagctcatgcctgtaatcccagcactttgggagactgaggcgggtggatcacgaggtcaggagatcgagaccatcctgcctaacagggtgaaaccccgtctctactaaaaaatacaaaaaaattggctgggcgtagtggtgggcgcctgtagtcccagctactcgggaggctgaggcaggagaatggcgtgaacctgggaggtggagcttgcagtgagccgagatcacaccactgcactccagcctgggtgacagagcaagtctccatctcaaaaaataaaataaaataaaataaaataaagtaaaatgaaataaaataaaactgcaaaacaaaatgaaaacatggaatgttaaacatactgaacaccattaagtagattactacatttggaaaagaaatcttagaagacaaatgtagggaaaaagtattagaggggttatatgaagataaaagaggatgaaaactttccaaatttttatgtgataaaagaaaaactaataccaatcaatactgtttgctttgaaattatttggaattactctggaattaaaaataaggaaacaataaagaacttacaaaataaacaaaaggtgaaggtatttatcaccactagcatggtcccacaagaaatgctacatggtagccaggcaccagtggctcatgtctgtaatcccagagtcttgggaggccaaggcaggcagattagttgaggctaagagttcaagatgagcctgaggaacatagtgagatgctgtttattttttttaatgccaaaaagagtccatatgttgaaaaatataatgatgctgaacagccttaaaaaactacatgaaactataaagctttctgttaaatgtaaatatataaacacatatacaattgtttaccaccataatcatgaagcaaaatctcttaaaattctgctataaaatttgaacaaaaaatctgcataaatctgttaatagatacacaatataaaataatatttgtaataataaaaaactacaggatgtaagcccgggcgcaatggctcatgactgtaatcccagcactttgagaggccgagatgggtggatcacaaagtcaggagttcaagaccagcttggctaagatggtgaaaccccgtctctactaaaaatataaaaacttagccagtcatggtggtgggtgcctgtaatctcagctactcgggaggctgaggagcattgcttgaacctgggaggtggaggttgcagtgagccaagatcacaccactgcactccagcctgggtgacagagcaagactccatctcaaaaacaaaacaaaacaaacaaaaaaaaaaccactacaggatgtaaagaggtatagtttttgtattcaactgaagttatgacatattaatattgttataactttaaaatgttttacataatctccaattaccaagataattacaagtttatagaaagtatgcaatacaaaatgagaaaggaaacaaagcataacactacaaaatcaaaaaaacaaaaattaagacagtaaaataggaaatgatggaaaacatctctacaagaaacacagaaaataacaacaatcaaaatggtaatagtaacttcatttctctaaggaatcattttaaatataaattgattaaactaataataagaaattaaatggctgaatggaataagaacaaacaaaatcatacaatatgcaacaaattacacaatattcttgtttgaacttggtgtactctgttaggacacataataagccttattaagtttaagaagactaatcaggtgtggtggctcatgcctgcagccccagcactttgggaggccaggactggaagattgcttgagaccaggatttcaggagagtcactttaactttgagtcaaacaggttgaaagaaacagaatgaaaaaacatattccatgcaaacagtatccacagttaagtgaggtggtcataattatattagacaaaatacactgtaaatcaaaaactagcatgaggtaataaagattgttactatataatgataacattggtcatttaccaggaatctataactattatatctatttaaaagatcagggttccaaaatatataaagctaatattgacagaagtgaagcaaaaaatacatagcaacataataattacagacattaagaccccactttaataatgagtgaaagtttagataaaacatcaataagagaacaaaacctggatgacattataaattgtattaattcattttgtattgcaataaatacctaagactgtgtaatttataaagaaaaaagatttattttcttcatagttatgcacaatgtacaataagtatggtgtcagcatctgcatctggtgagggtctaagtaagcttacaatcatggtaaaggcaaagagaaaccagacatattgcatggggagagagggagcaagcatgaaaagaaagtgccaggttctttaaacacgcagctctcacatgaattaatagagtgagaactcattgatcaccaaggggatggtgtgaagtcatttacaagagatttgcccccatgacccaaacacatcacgcaaagatccatatgctacattgggaatcccatttcaacacgagatttgaagggtacaaacatccaaatcatatcatagaccaactacacattaaaaatatgtacaggaccctccagtaaaaaggaacagattacacaatattctttacacaatattcttgtttgaacttggtgcattctgttaggacacataacaaatcttattaagtttaagaagactggccaggtgtggtggctcatgcctgtagcccccagcactttgggaggccaaggcgggaagaccgcttgagaccaggatttcaaaaccagcctgggcaatatagtgagaacccacatttctacaaaaaatcaaaaaactagccaggcgtgacagtacacgtatgtagtctcaactacttgggatgctgaggtgggaggattatttgagccttggaggttgaggctgcagtgagccaagattgtaccactgcgctccagcctgagtggcacagtgagaatctgtctctcaacaacaatacgaataaataaataaatttaagatgaccaaaattatacagttatgttttctgactaaaataaaatgaaactagacatcaaaatcaagagataaactggcaaattcaaaaatatatggaaataaaacacactctgtaatatattcttgctcaaggtccagataatttaatcaaatgtgaaaacaactcacggtggtgaagaaattccaatggtacattgttgaccagaaatattgtttaaaaatttttaaattgattatgagctaaaactagccaaacacccatgagaaagaacaaagaggcattatatttcctgatttcaaaatatattaaaaagctacaataaacaaaagcaatgtggtactaacagagacaaacagatgatggaacaaaatagctcagaaatgaacccttctttatataatcaaataatcttccacaaagttgccatgactacacaatagagaaaagaaaatctcttcaacaaatgatgttgaaaactgagtatctacactcaaaaaaataaagttggattattttcttgcacattttaaataaaataatgaaactaaaaaacatataactaatacaactcttagaagaaaaaaatagggaaaatacagaacactggttttggcacctttttgtagatatgacatcatacttatgaaaaacataaaaacccccataatttaactacactaaacttcaaattttctgcataccaaagaaaatatttagcagaatgacaatgccaccgaagaaatgggtgaaaatattcgcaaattacatgtgatgagttaatattcagaattataaacaactaaaactaaacaacaaacattgaataaattgatttagaaatggacaaagaattgaatggatgtttaatcaaaaatatatatataagtagaaaaaagcacttaaaataatgcaaaaaaagtaccaattgtagagaaatacaaaacaaaatttcaatccaaaacaaaaccacctcatacccattagaatggccatgataaatttttaaaatgccaaatctgttgaggatgtaaagaaattaaaactcatgtgaattgttggtggggaaaaaaggatgcaatcatcatattatgaatgtttcttaaaaattaaattacataattcaggaattccacttataaacctatattgaaacataaatcatattatttgactggaatataaaatatatttttatatattaatatatttataaatggaatccaagaattccacttataaatctatattcaaacataaatataaacgtatattccaaatataaatctatattcaaagaacctggaagatatatttgaatatatatttgaaatattggtataatatattataccaatatttatatatttaatatatataacatttacatattaaatatataaatactggtaaaatatatttattataccaatatattatatataaatatatacatatatatttatagatgtactatatatatataaagatattataccaatatttacaaaagccaaaaggcagaagtaacccagatatcccatgactgataaacaaattaaaaatgtaacatatacacatacagtggaatattattcagccttaaaatagtaaatcttgtcacattcttacataaacgttgataatattatgtcaactgaaataagatagtaacaaactgacagatactatatgattccatgatgtgagtcatcgtaagtggtcaaataaaaacagaaaggagaatggtgttactcaaggtctaaagagagggtaaaatgggcagttgttacttaatgggtattaagttttaattttagaagacgtaaaaattctagaggtctttatataacaatgtaaatacttttaatgactaaaatgtacaccttttttaaggcaggttctactctgtcccgcaggctggaatgaagtcacataatcatagctcactgcagcctcaacctcccatgcacaagtgattctcctgccacggcctcacaaggagctaggaccacaggtggacaaacctggctaattttaaaatttttgtagggatgggctctctatatgctgaccaggctggtctcaagttcctgggcttaagcaatacttctgcctcactttcccaaaatgctggcattataggcatcagcctccaccacactcagtactgaaatatagacttaaaaagctttaagatggtaaattttatgttatgtgttttcacaattttttttgaaaacaaataaaagtgatatacgtctttctatgaatcacaaaatatataaatatataaatataaatcacctccaaatcacaaaagtgtttctctcacacaaaggaaatatatatatcattaaacacctggtgaatataccactatttctatgactactcaccttcacataataagacaactattgaaaatcagccaagaaggctgggcatggtggctcactcctgtaattccagaactttgggaggtcaaggcaggcagatcacctaaggtcagaagttagagatcagcctggccaatatggtgaaacccagtctctactaaaaatacaaaaaaattagccaggcatggtggcaggcacctatagtcccagctacttgggaggccgaggcaggagaattgcttgaaccagggaggcggaggttgcaatgagcaaagattgtgccactgcactccagctgggcctctactgtggcctgcagaccttggcctctactgtggcccctgaaggagttcagtgactcagtttcagctgtctttgccacagttcacagcaattcctgccaacacaggaacccacacagtgatgtggaaaaaaacttccaaatactcagtggtggccacacttaccacatcccgatataagttccaccatatgcagacccaactgcagaaatctgtcctagtttctgccctataaataaaagtcctgaaggaaatccagcctgcccagacattagatgggaatcacaacaaccaaagcccctggtaaaaagccacttgaaggtggagtccactgcatacccagcagccttgtgacacagttacaaactcttccctattacaagctcatagggcatcccattaccctggggacccaacaaaagaagatctgtacctcctgaaaccagtttataaaaaattaaagagctgtttgcttcttcaaatttatagacaccagggtaaggctacatggttccattgccaatgtttctattttaacatagcagtgaaagtactttgcagaagaattagtcaagaaaatgaccgtaaaaatgacattcaaattgaggaaaaaaaaattaaaatgttgctgtttgtaggtgacatgatcttatatatagaaaaccataaacagtatatcaaaaactaacaaatgccctcagaaaattagcaatatataacattaacatataattatcagttatgattccatatgctaacaacaaaccatctgataaaaaaggaagaaaacaatctcatttccaatagaattaaaataataaatttctgaaaaataaatttaacaaagaaggcaaaagatctttacactgaaacatatattgatgaaagaaattgaagaagtcacaaataaatgcaaaaagatttcatgtttatgaactgcaagaataaatattataaagtgccatatgattcaaagtgatctacggtttcaatgaactccctattaaaaatccagtgacatttttcatggtaatggaaattacaattctaaaatttacatgaaactacaataggctttgaaaaaccaaagcaatctagaggaaaaaggacaaagcaaccaaacttcatactttatgatttcaaactatattttaagattgtagtaaaaaaaaacaagaggatacatgcaaaatatggacacaagaaaccaatggaacagaacagagcccagaaataaacccgggcatataaattgtactaatctttgacaagtgcatcaaaaatacacaatgaacaaagtatagtctttttaatatttggttctgaaaaaactggataccaccaggcaaaagaataaaattagcttatttttcttacaccatgctaaaagttaaattacagagttaaatatgaatccttaaaaaacctgaaaaacaaatacatggaaaacccacatgatatggtcttaacaataatttattagacataataccaaaagtacagcaacaaaagcaaacataaacaagctggactgcatcaaactaaaaaccttctgcacagaaaagggaacaataaaattaaaaaatttgtagaatgggaaaaaatatttgcaaaccatacatctgatgaaagattgatatacaaaatatataagaaatacaagcagattaaaagcaaaaacaacagtaacccagttcaaaataggcacaaaactaaactgatatttgtccaatgaagacatacaaatggccaacagataaaccataaagtactcaatatcaccaaatatcaggcaattgcaaatcaaaaccatgatgagtatcatttcaaacatgtcagaatggataatgtaaaaagaagaaacataacaagtgttgacaacactttgaagaaaaaaaattctgtacattcttggagagttaaaaattgatggagtcattacaaaaaccaagaggttatttgaaatacagaactactacacaatctagcaatcccacttctgtgtatataacaaaaggaaatgaaataagtaacttgaagacatatctgtaccaccatatttgttgcagcattattcacatttgccaagatgtaaaaaacctaaatgtttgtggatgctgaataaagaaaagctggtataaataaacaatagaatattatttagcctgaaaaataacaaaatcttgccattgcaacaacatgggtagaactggaagacattatgccaagggaaataagccagacacagaaagagaaatactgctcattctcacttatatggggaatctaagaaagctgaactcacagaagcagagactacaatggtagttgtcagggactagatatgggagaaaatgaaaagatgttgaaaagacacaaattttctgttatgagtaagtttttcgaatgtaatgtatagcttcatgatacagttaacactaattttttgtaagcttaaaatttggtgtcagcagattttagatgttttcattacaaaaaaggtacctatgtgaggacaggtgatagaaatggtcataaacataattgtgctaatcattttacaatctacacatgcagtaagtcactacattgtacacaataaatatataattatacaatttttacttgtaaaaaaatccacaatacacacctacatatatatacacacatataaattacagttctggtaaactttatcctaaacaagataaaattacaaaatagtaattaaaaaaacaaggaaagaagtgggagcttaacatatgctcagtaatgttctaagttccctgacatagtgaattgaagaaatgtaggaaatatatacattatattacagttgagaaattaagacagagttgaaattaccaacctcagttagtactaaaacaataaaaatttcaattcaaataacattagatattcttaaagatacttaatattctgattaaattaccgagtatgaatttctgtagaaacacatttgaaacctccataaaataagaaactataaagcagaaaacatacaacatatgtttgttgtatttctgggatttctgaaccaaatctcaatatcactacttttacatatttcagacacaatgcagaaagagaacttaaaaatggttaaacacagagtttctaaaaaatatgcagctatatgtatatccccaaaagcaataaaagtagtcagattgtgcactcctttataagccataaagagaactttggctctcactgcaaatctgaagaaaaattattgaagaaaaagtagagtcgttagagagcatgggacagaagatgcccctatgtgagaacaagtgaaaaaacccaggcttctcagaaacgatttccactgaagcacagcttcccaaatcacatgtaaaagtctgggttcctccttggcctttggatctctcatctatgtcatcctcttcttcattcgctttcacctacctggatgcttcatactccatggctttttcctttgctccagacaggtgaccaggtctggcttagagaagacaatacgtgttttattttaaaaagcagcaagagcatgacttttcctgggattcgccatttaccaacctaatactgtgctaagtagagaaaagaggacataatagaagattctagaaaattaattccaaaataatttttactgacagaacctttagcatattcagaaagtacattaaatatgtgggtcctcagtttcactccccagtattactgaatcaaaaattggtggtggcaattgaattttaaggtctggacaacattattttatgccactaaatttctgaaattaccacttatctagagtgaataatatagataagctcaggaaaggggaaaattcaggtcaaaatgaaacatcttgaagaatttattttccacaccaaaaaatcctcaagattgtcttgaaagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcgtgaaaatggtcatactgcccaaggtaatttatagattcaatgccatctccatcaagctaccaaagactttcttcacagaattggaaaaaaactactttaaagttcatatggaaccaaaaaacagcctgcatcaccaagtcaatcataagccaaaagaacaaagctggaggcatcacgctacctgacttcaaattacactacaaggctacagtaaccaaaacagcatggtattggtaccaaaacagagatatagatcaatggaacggaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatccctcccttacatcttctacaaaaattaattcaagatggattaaagacttaaatgttagacataaaaccataaaaaccctagaagaaaacctaggcattatcattcaggacataggcatgggcaaggacttcctgtctaaaacaccaaaagcaatggcaacaaaagccaaaattgacaaatgggatctaattaaactcaagagcttctgcacatcaaaagaaaataccatcagagtgaacaggcaacctacaaaatgggagaaaattttcgcaacctactcatctgacaaagggctaatatccagaatttacaatgaactcaaacaaatttacaagaaaaaaacaaacaacaccatcaaaaagtgggcgaaggacataaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtggaactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaacacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacaccatatgttctcactcataggtgggaattgaacaatgagaacacatggacacaagaaggggaacatcacactctggggactgttgcggggtagggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataagattgtcttgaaaacagggatctgaaattcactcatgcaaagcagaaattaccaaaacacatcctacaaaggaagaaaatgaaacatttagggtaaattaggaattctatattgaagttatcctcaaccaagaagaccgggtttctgtggttctctaacatcacatcgttatacaaattctgctgagcagcatccaggtattgatactcctccggacagaattctatgtggctacatccctgaatatcagcagtccctgaaaacacacacacacacttcaagtggccatgggcagaattcttaaattgtctcaagattaaatgagtgaagagaactgattctgacttatactactgaaattgtcctataaaataattcccaacgaagaaatattctgtgttgtattctctatctctgagaaaagagagcataagattcacaacaccagtgtagtgtattgatgatattttttgaatgataaaagtacaaaattaacaacaggaacatagacatgtacatttttgagtgctcaatttaatcatacagtataagttgtatatttctcagattaaaaagtcaggcttagttataaagtacctctcaaattttaatgtgtacaacaataaactggagatctttttatgcagattttgtttcaagaaacctgaggtaaaacttgagtttctgaatttctaacaagctcacaagtaacaccaatctttctggcccaagataaatcttttgtcaaacattcattaagtggcagagcctgggtttttatgaccagtaaacaaagatgagagacttcactttttaaagaaagatatatgcaaagagaatctaagaagaaaagagagtttccagattacatgtgatgctttatgcacatcagctggtaaatgtccccaaggtactcaataataaagagaaaaatatctctacagtggaaaaaaattctcagagaactatttaactaagcgaatcaaattaacaccattgtaacagaacaaattttcatcatgcgctgatgctcacagaaggacacaatatcactgctgtgatactggcccccgccaaagaagcaaattataattcaaatttaatcataaagaaacaagttttatgcaaaatgcaagctacagtaatcgctcatgttgtgtaatctctaatagagtatttaggcagactttccttagcattctagaaagcgagtatctcctcattatttttttcaaaactttctgaattattctgggtaataaatgccatcctgttcaaatgtgcatattttaatcctgttccgcatggagttgatggagcacacagacagaacttcaacattacatattcccctttttcatgaatatctaagaaccccacctcttccccagtaggaatcttgggtatccatacctttccatgtgcaccagcaccagcaacaaagggtatttttctttttttttttttttcctttggagatggagtctctctctgttgcccaggctggagtgcagtggcacgatgtcggctcactgcaacctctgcaacctccacctcctgggttcaagtgattctcttgccccagcctcccgagtagctgggattacaggcacctgccactacacccagctgttttttgtatttttagtagtgacagggtttcaccatgttggccaggctggtctcgaactcctgacctcaggtcatccacccacatcggtctcccaaagtgctgggataataggcatgaaccaccgtgcccagcaaaagggaatatttttaatattacgagtcgtaaattaatgatgagaattcttcatggcggagaagaagccaagatgaagagaatgtcgagaaggctctagtatatagaaaaaaaatattttttcagagttccttgactatcatgagaagaaaaaatgtttaaataaacatatagggagaaacagcataaagtcaagaagtacaggtttgtaagttctaaacatacggcattccaggaggcaaagtgaacacagcgcctgatctgagacacagtcacctgagaaagagccatttttctcttcatcatcctcctctaggatttcttctcaggtgatattctctggacaagtcacacctgcatcttgggaatatgcctttaaaggaatcagcacaatcccttcacctgctaccaccacaaacacaggcagaaagatccaggcatgcagaaaatgtccacccatttatgttgtttataacaggtgagattcaaggacagtgaactcctccacgaagatcaaaatttatctttctcttttcctgccctcaggtgccctcccctgccacagacactgcaatttctgctacagcaatgggaatatgggccacactaacttgtccctaccaaatccaaccatagcaggccctgtgacctccctttggaataaagtttgaactcaactctcatgaatgtattttgaattcctcatatttggccctggcctcaacctggagtcacgtgaggcacttaattatatcaacaaggatgcttccacccagaacaatatacagagcctgcggtaagggcacaagtgaaaatatttctgcaacctggccatggaatcttaattagaagcctgggccaagaaccacttagctaagtattgcctctcaagcttcaatgtgcatataaatcatttggtaaccctggccccacactatgtaatgtgattctgcaggttttaagagggtccatgaaagtgcattttaaacacatctcctgtcaatgccgatgtagcttccccagacccatcattagtagcatttagctagaaaaagcaggcatggaacagactcttacactcatcacttatcacaacacaaatacttctcatcaaataaacaatcaatctctatcctgaaagaccacattctttgctagctctttaaagtttacagagacaggagaaggcagcaatgtctgcgtgtctgcattgaaaaacaacatgcacacatatacttatgcaatgcttattaaacaggtactatgtgctcaggagtctgttacagagcactctgctgggaacatcacattatgtgatttaatcttcgtaacaacttgagagttgggtactaagtgttcaataattctcagaatttagatgaaggggccagcattgttttcttctcctgtttatcttttttgaaatggagtttcgctcttgttgcccaggctggaagtgcaatggcacgatctcagctcaccacaacctccacctcccgggttcaagcgattctcctgcctcagcctcccgagtagttgggattacaggcatgcaccatgacactgagctaagtttgtatttttagtagagacggggtttctccatgttggtcaggctggtctcgaactcccgacctcaagtgatctgcccacctcggcctcccaaagtactaggattacaggcatgagccacagagcccggcctctcactgatttttttaaaaatgtatagcataagagataaatatagacagatgggagggatacagaaaggaaagggttaagtgtagttcagagggattttttattgtgtttctatttactttcttgtgactagtggagtaactactggaatggaatgtctctacaagcactggttttaattaaaaagaaagaagttaagacctcaaaatatatagtttattgctctaatttatctgcttttgggttgaatactgtgagcgtaagttctggaaaggcagcaggagccaactcccaaatctctggtctcctctaatgagttctgtgaggacagactccagggtgggaccagacctgaaggaggctcagaaaagggtgaatctggacagagctggggtggagaaacggtcctatgttgaattatgatctctatgctgctggagtacttcttgttctgtctttcctaagcctgtccaagagaaacttaagagtttgtataattttaatccatttagccactactctattttataacatataataacaatttaaccaaaatttttagggctttctaagataattttattagaaaatacgtattcttagcaaggtaaaagcaataaaaatacaaatagctctcctgtttgagatcttcaggtggtgacatcagaagtcacaacaacataagagccatcgccaaagtccccttaacaccccactttattgtactgactatatgatgcttaattaaaccatttatccagttgctctacactgaaagtttttgaatgacagggaccatgactgcttcatctatttttctaaagaccatatgaaatggaggcaatttgtttatcagtctgagtctccagaactcctgaattttttgccaaggaaactggagaaactctcatctgggtaccaaccacggagaatctttctacaaaagaaggaacagacactgaatgactcatttcccttcctctaacatggaagcagaattagacactcctgccagcctgacccaagtctgcacaggacatcctgaaatgtcttaaagattcccgggtgactgtgagaggattcctagtgaccatggactgatgaccctatgttgatccaggcaggaaagactcaagctgattctaaatagaaaatggaactgccctggtagagctccagaacctggatctacgtgtgatatcacctgttctgattagctagctcttaggtaatactcaagaatactctattccagtgtcacattttacaaataggtaaacttatgtcattgctctgggtattttgtggctttgatctctccttgctgacatgcatgtttacacttacagattgtgcaaccagattctatttacaccagcagcctctcacttaaccatagcaggtcactggaaaagatctggaaagctcaaagggatacactctgaaagaagggctttaagatttctatgctgacatctcacagatcagaaaatgtctcctatgggttttctgtacattctcaaaccaaaatctggctctctcctgtgaatcccaggcagagctcagctcttacgtgcagattacaggtaagatcaacctgactcttcattctttggtgttacagcaaggagagttaaaaaaaaaaaaaaaagtttccatcataaagtctgctctagcacatgatatgtcagcctaaaaagaaaaggctaaggcaacactcatttaagtagagagtttatttgggccaagcctgaggattgaaacctgggagcatagattcaagttgccttgaatgtacactttaattagcagcagttacaagtgcatttacaaaggcaaaagagagggacggggagtggactgaaacaaagttatttgtcagaaattcttcttgttctacagaaataacattgatgactaattggctatataatttaagctataaggtattgcttataacatctagtgtggcattattaggttaatttatatctacttgtagcaatagcaaacagtttcaagaggtaaaaacgtagctcaaaggaggcagaagaacataattatgttctcatttttatgtctctccgggcctgataaaactaaaaggacttgcactcctcagatcaaagttattctttttcctctaatctcaagaccgagattcagaatttggtactgtagatttaggtcctggatgggtggagaaatggcaggtgttaactgcacatttatgggaattttgggaggaggagaaagaggaacgctgagatactcacgtttactcaatgcacacgtcaccctaattgttcttctgggcctaacagtctccaattcagtttcaggtctgaagacactatggtcactgaaagaggtgaaatggctgattactgtcctgtgaattttgtcaaccacttgtagaaaggcttgacctctctacaagtggttgtagaggactatagatgtgaaataggcagagacacaattctgcttgcatactctgggggcagtgtgcactttgaagcaaaactgactgggttgactggaagcctgagagggaaagccttctccaaagtgaagattggtgggcaccttatacgtatatacaatgtctggtaattgtggacagtgtttgacaaatataattaaaaggaaaagacagaaaataaaaagaaagaataaaaaagaaaaagaaaacctttgccaaatcaaaagcaaaagcaaaataatggttctcaggtcctagacaaagacaatctggtagggaatgagacagaaaaagcatttatttctatgtaaaataattaagcctcttattcctaaattgtattttcttgtacaacagccagaactataggcatggttttgaacttttggacatctgaattttagtatgcactggatttaggcacctaaggggtggttctgaacacaccgtgtgcacatgaaagaaagactgtggggcaaaaagtagaagagagaggccgggagtagcggctcacacctgtaatcccagcactttgggaggctgagtcgggtgcatcgcctgacatggggagttggagaccagcctgaacaatatggagaaaccccgtctctactaaaaatacaaaattagcctcattacacattactgaggcaggagaatcacttgaacctgggaggcggaggttgcggtgagctgagattgcaccattgcactccagcctgagcaacaagagtgaaattccgtctagaaaaaaaaaagtagacgagagaaaggagcttccaaaaatttatgagtcggggaagaataaaagatagctggaaggactggtttgaattaaagatgtggcccaggagggactgtactatgaattttttgtgttcatgcaggcaggtgagattatgaacaggtagtccagaatcctaggttgatggagagaatgggttgctgctgcagattcagtgtctgagggcagaaataagctaggagtcctataggtacttgtgtaggtttctggcaagaaactctagcagcaaaggcactgtgatggaattcctgaggttggtgcctagtcctgggaggcgcatggccacattaatacctcctagtgggtatgttcatgagtaggtaaaaaccaagtgatggcagctgtaggggaagaaggtttgttctgagaactccttttctctaagtttccattcccctctcaccctgggagaactggaatcacaggagaatgtgcagtgtgactgctcatgtgcaggagaacacacagggtctgatccctagcccctgtgatgtctttcttctgacatcacatggctcaggcccggtgacgtctttcttctgacacctaatttgtagaatttcctgaatatccagcaattctccaacatcaaccagttgtttaacattttatctcacactactcaaaatcagtgcagatcccacaagtccagagtttagtcccacaatactgtccttactgcagatgcccgtcacaagtcccaggtgctcatctgtacttctgagtgactgtctagagcagctactttaaatggttcaaattattgaacccctcctggaattgaataatgtgattaaactactcacagaactcggcaaaacactatacttgtgtttaccagtttgttctataagatacaatgcaggaacagtcaaatggaagaggtgtatagaaaaaaggaaagtggtgtgaaaagatgggggcacacagaaaattttggtaaataactgtgattaataaaaatttctcatctattgtgttctccaggagcagcttaatgaaaataaacaactttcccattgtgacttagatgatgcttgcttttttcacctatcacatagccagacacagactctacaaattttcatcattttcccataaagaatcagctgaacaattgtctttagtgatcataacaacatactttttaatccaactttgcttaagtttctctccttccccagactcctgaactttgacccaatctcagtctgagcaaacatacaacctcatgttatgtccctgctaaaaagatactgacttcagggtaaaatattctctgatctagagtctgattttgccacccttcatcctgccctcccctcccatctcctttctaatcttgtttgcttctccctaggaaagacagcccttgtatgcctaacctttgaggtcctcaaagatcttatagtctgtactaccccctcttgtaatactcctttggaaattcaaaactttttacttaaatctgactttttttatttgacagagtctagaaacaaccccaggtcaataaaaatttcatcctcagaaagaccctcccaatgcccttccatcccaaccccagctgcatctgcctatggatccccagctcgcctgggctctgtagcttctctcagtagaaaggattcttccatggctggggtgagcgggctgggacacctgcaggaaaggctcctcaggaagaaataactggaccttcaataacctttttttgcagtctcaatattggccttagcttggagtcactgggctcaggcttcaattcccagtcagagttattcacttggctttttaatactaagtgtttgaaaaattcagcaaaattgctcaaacacagagtttatataagggaagaaaattttaggccgggcatggtggctcatgcctgtaatcccagcactttgggtggccaaggcgggtggatcacgaggtcaggagttccagaccagcctgaccaacatggtgaaaccccgtctctaataaaaatacaaaaattaaccagacatggtggtgcacacctgtaatcccagctactcaggaggctgaggcaggagaattgcttgagcccaggaggcggagtttgcagtgagcctagatcatgccactgcactccagcctggaagacagagcgagactccatctcaaaaaaaaaagaaaaaaaaaaaaaagaagaaaattttaaagtgcttacttacattccatgacttaacaaaaaaagcaaaactatccctttcagacaataaacatgtcattaaattattttataacaaatcatttagtaaacaattagtcacttgggaacactgctaggaggtggcaagtcccatctcataaaatttagcatttatactcaaaaatcaagataacaggatatagagcagagatagccactgtcacaattcaccctacaaaaatcggaactgttttgatgaatctacacatttcaccaactgatctatcatattttcttgtagaaatatattcattatctatagccataatggaataaacattttttcctattctttttcccagtagcactcccaaagctaagccctgggattttgtttgaatcttccctctcttaaaaaaaaaaaacacttgacaacctttctacactcactctggggaacaaaaaggcaaataagaatttttaacaaatggaatgtatgactaaatatttaattttttcctgaaacctacctttttcatgtcctttgtatattttcttaacctttcaagctctactgataaaatgtaatttacagttaaaaaactaataagtgaacaaatatcttcgaggtgaaaaacctagaaattcaaatgctcattggaatacagatgtgtttgattcatgtgtcaagtcaggccatccaacaaatgagagatcctcccaccctcatcctgatcgcttaagtgctcaatgaccatgctccaggagaaactatgctatgccccagtgagggcctcaagtgcattttactttgcaggttcttgcaccatctcactgggttgggtagtttttgttttttggactattttctttccttcacaaatctgaaagaatcaagggcaaaaattatttctctcttttaacctcagtaccagcatctgattagctgaccagcaatatgtctccaagaaatggaagctgggttggatgaaggcaaacttaatgtctcaaggggttagctttttagaggaagggtacaccaggagatgtctctctgacccagggcatccacctgctcccttgagaggctacattctttaactcaggttgtcttctggaaggaaaatgactcagaagctgatattcatgggacactctagcagacatggccaaggtgagtattttgggttatccctagacagtatgaaacccaggaccaagataaaactggatcatatctgaggacacatcaccttgtaaaaattccaaaggcaaccccaactcaaagacattctgggccaggcatggtggctcacgcctataatcccagcactttgggaggctgaggtgggtggatcacttaaggtaaggagttcgagaacagcctgaccaatatggtgaaacctggtctctactaaaaatacaaaaattagccgggcatggtagcacaggcctgtaatcccagctgctccggaggctgaggcaagaaaatcatttgaacctgggaggtgaggatgcagtgggccaagatcacaccactgcactccagcctgggcgacagagtgagactctgtcgcaaaagaaaaaaaaagacattctgataagatatctgtgcctagggaagataaaaggaggcacgaaggttttttttgtatttttttttgtatacttttaagttctagggtacatgtgcacaacgtgcaggtttgttacatatgtatacatgtgccatgttggtgtgctgcacccattaactcgtcatttacattaggtatatctcctaatgctattcctctcccctccccccaactcaggacaggcccgggtgtgtgatgttccccttcctgtgtccaagtgttctcattgttcaattcccacctatgagtagagaacataagaggcacaaaggtcttttacaattaagtatcagaagacaactgtgcttttttctcacgtgaaatggttacgaacagaaaacaaatctttctaaaagtgttatccaatgctttgtgaaaaaatgattaattaaaatactgtgtctgaaatgtacagtaaagtagaaataacggtaatgttgtgaaccatggaggggaagttagcatttgagaatgtcagaaagaactggaaagttagtattttactacaagagagggttaggctggaggaacggtgacggggaggtagacttgagaccctgcttgagccatatttggaaaatgcaagggaaaactagtccccagtggagtgtgaagataattagatagcaggcaattagaccaaggtggctctggtgccctgagttcctaagtttaaaaaaatttaactcaaaggcacttctagtaaatttctgccttgcggtaaacaaaattcaggcttaagcaaccacaaacctccaataaacctctgattacataaccaaaactttcccacctgcatcgtacaaataaggcgactacattactgtatccaaccaattattgaattcgatttgcttcctcactgcctctcgtaaaagcgtttccttcgggcgggcgcagtggctcactcctgcaatcccagcactttgggaggccgaggcgggtgggtcacctgaggtcaggagttcgagaccagcctggctaacctggtgaaaccctccattaaaaatacaaaaaaattagccgggcatggtggcgggcgcctgtaatcccagctactcgggaggctgaggcaggagaatcacatgaacccgggaagcggaggttgcagtgagccgagattgcgccattgcactccagcctgggagacagagcgagactctgtctccaaaaaaaaaaaaaccgcatttccttcaagccctcacaatggacaactaaaaacaatagttgggtgctctacgattcttgaatcgctctttgccgaaatttttaaatatttttgcagtgaccccctcactttttttttttttttttttttttttttttttttttttgtgagacggagtctcgctctgtcctccaggctggagtgcagtggcgtgatctaggctcactgcaagctccgcctcccgggttcacgccattctcctgcctcagcccacaccccccccacccggagtagctgaggctgcaggcgcccgccaccacgctcgttttttgtttgtttgtttctttgtattttcagtacagacggggtttcaccatgttagccacgatggtctcgagctcctgacctcgagatccgcccgcctgggcctcccaaagtgctgggattacaggcatgagctaccgcgcccggcccccaccctccccgttacatttttaacaggagaaaagagggaccggggaccccacaaatacacctctttgcatccacaaatcctgctcaccgagtcgagattctcccgtgatgacgctccaatcatccccgcacacgctggggaagacgcgtggctgtgggagccgagtggcacagggagggctccagactggggagccggtgtcgccacacaggcaggggactggagcccggggtcccagcttccagtccagccgacatttgtggccgagctgggccaggagggactcgggtccacaaacctagaagacgactgcagggaggcccagtcacgctaccgccgcttcggcagcggagcctagcctgccccccatctcttgggatgtcgagccggcactcaccatttctctgcttccaggaaatcctggcgtcttagctacgggtctgccagtccctgcaggtcgcacagccacagcagctgggcctgtaggagcagagtacgggggagcagttggggggcagttctctgtgaactgaagactagatctgcagccccagctgcggcaggagacaaatgcccccgccaacacccggaagccgcccttgtcctctccagctgcagcctgattgcccggttttcggccccgtgccccttattggataaagcttcaggccccgtccccagtccgtgagtgacagaagatgtgaccaaacactggactcaatgaggacggagtgacaacctaggctgcagcctttcctggcaggcctttatccctgctctgagcagggcctaccctacagggtatttgcatttaaccttgtgtataaggtcatatccatttataaataatatgttttatgttattcacaagtggaaagagtataatgagaattattttagaattttggatttcatgatcttcctggccctagtcttttgagcaagcagcctgagattacaaggaggaggtattcctctggagtaaaacgtgagccatgtgtgaattttaaattttctagtagccatatttttaaaaagtagaaagaaataggtaaaactgactgtaacaatttatttaacccaatatgttcaaaatattatcattttaatatgtaatcaataagcatgaagaatatatatatatatggtacaaaatatttgaaactcactccatattttacctttctagcactctcagtttagaccagtgagtttccaggcactaagtacccacaaatggcaagcagctgccacataggagtgcagctctgatttcagtggggtgaagggccagtaaaacatcccttttctgtcagaggtgaaaaaacagcctctcctcaccaacttctctcctcagatccaagggtataggagacagtgcccatacagggagaagagggtggaaaaaataaaatgttcacaggtagaccattgctgccaacctgctgcctgcctgccttctttccagaaatcagacagtaaacaaaggatgatagggccacaggagaggggaaccccatgtttttagatctggctcacagacttgacctccaatgtttagatatggagaaaatgaattaatggcaaacgtaatttgctatttggccatggccctaataatcaggctgtggttttctcttttctcctgtagtgtggggatcgtgtaagtataagtaccaatcacatgtgtacatgtctacatgcatttttgcattactcaacattatcttacaagatatccaactttaaataagggacaagaaaatcgatacctatgagatgctcactgttttcaagtaatagtaatcaatctgtttttgaatcctaccaggctgtctacactgggtgcatggattagttagttattgatgcataaaaaccacaaaaaacttagtagctcatgattgacatgctcagccatttaggcttggctcactgagccattcttctggtctgagatgaactccatcaggcatgtatggtaagctgctggttgagtaggcagcttgcttccaggggtaagctgactgtcaacaggggcatctcgcttctcctccccataatatctcagccttcagctgggtaacaggggcttgttctcatggagatggcagcattccaaaacaaaaacagaaggattcaagatcgtttgagcctaggctcaaaactagcacactgtcatgttcacaggtttctattgccctaagcagataagtccagccagatccaaagtttggaaaacagatcctgtcacttgatgctaatagctgtaaaagcaccttgctatgggcataaatacagaagggatgaagaattgctgccatttttgctgtcagtatcaccctgcctttccttgcatattaggtttatagaattcttttacatcaaaaaacttgtccgaagacccacagctactaagtggctggactgggactctggataaactctacctgactccaaagcccatgtgcctccacagactgcaccactcaactagctttcctcgaccttggaaatactgaagtgtgacacttccgtaatagaggtcagactccttttatattcatgctaagtagtactgtttaccactgggaataatcccctcaaaaaactgcagaagtattttagaaggacatgaaatagtctggggaaatgactgagggagaagttaaggaaatcaaagcccaacaacctcttacttatttttcatcataggagaaatttgaaaactgttaaaagaaaaaaaccttagacaaattaaatttagtagagtgtaattgagcaaagaatactttgtaaatttggcagcctccagatacagagtaggctcagagagactcaagcacagtcacataatggaagaagattaatggtcagaaagacacagtgacatacagaaaacagaagtgaagtacagaaacaaccagattattacagcctgggatttgccttatttgaacatggtttgaatagttgaccccctttgattggccaaaacagtgactgacccaagagtgggttacagtctgtttacacattcaattaggttttagtttaccatgtacagagaaaattttgaccaaaattaaacatgtaggaaggcagatttaggctaaactcaatttaacaattcctcccttttggtcattctctcaaatttgaaagatagagcaaaattttagatattagtattaccctgccccagtgataaatgcacttctttggtctcaaatcctactgtgaaatagcagaactgtgggttttgtaaagtggaaacaatgactttgggttattattttttaagagttggagtagaggagaactccttgtgttgaaaccttctgtttacagaagaaaaacgaaacctggtatgttttagaattaatccttgttttaagtttcagttcaattatgttgcgtttagcatgagtgactccatttcagcttggcttggtatgttggggctcagcgcatgagcttagttcaaaacaatggtgtccaccaagtctgtttaaaaaccccccattttggctgggtgctgtggctcacacctgtaatcccagcactttgggaggccttggtgggcagatcacgaggtcaggagatcgagactatcctggccaacgtggtgaaatcccttcttcactaaaaatacaaaaattagctgggcgtggtggcacatgcctgtaatcccagctactcaggaggctgaggcaggagaattgcttgaaccagggagtcagaggttgtggtgagccaagatcgcacctgggtgacagagcaagattccttctcaaaaaaaaaaaaaaaaaaaaacacctgtttttaaattttattttattttatttttgagacggagtctctctctgtcgcccaggctggagtgcattggcacgatctcggctcactgcaagctccgcctcccgggttcaagtgattctcctgcctcagcctcccgtgtggctgggactacaggcgcccgccatcgtgcccggctaatttttttcttttcttttttttttttttttgagacagagtctcgcaatttttttatatttttagtagagacagggttttaccgtggtcttgatctcctgacctcgtgatccgcccgccacggcctcccaaagtgctgggattacagatgtgagccaccgcgcccggccaaaacccacctttcttaaaatcaggttcttacttcagtgagagtgtggccaaaactcagggccttagcgccactctcagttaccatggttttgggtttccagtctcatcacatcattcacaggttactgtgtcctcatggttacatatttctttgaatttgtgattccagttaaaaaggaactatttgacattcgagagatggctgcatgcaaacatttatagcttttgagagaatacagtgcaccagggagactaccaagtgaaaaataccaagagtttggagtatgcattttggccagggatcacatgaaacgaaccaactaaaattaaatagatcaaagaatgagctaaataaagggtttactactgattttgatcaagtagtttgtttattaattccagacaactgaatctctgtaatatccaaagtattcttttatgtgcaactacaagtatcagtaactgcacagatacttctctgtttgtccagtaagcacataattctatacttagcacaatgttcacaacagaatttaaagtctgttgtgtagcctttacagtagaatctgctacagagcctattatgggggttaaattactaatcattgcgttatttactctaaaccatgaaaaaagaaatctaacaattgatacccatccagaagagtgaaggccttctggcaatgccctttatactgaaaaatttctatttaacctatgaagtaagtaggttaagagcagtgggccaatgttccttttctgatattataaggaaaaaaagtcccattaatatttctcacccacactggcccttcatctttcatctctcaaggcataagtttgtccatgtataaagttggctgcaaaatcctctgcatagatagtatactccatgaggggacaaaagactgcttttttatttctattgtttgtagggccataagcaggaaaaaacagagctaagagtctcatgacagcagagaagttttgattcataatcttagagaaaatgctgtgttaagaatgtcatctgcttctgaggacaaatttatctggttagctttacctaaaggtctctgatgtatataaaattctggcagggcttagtggctcatgcctgtaatcccagcactttgggaagccaaggtgggcggatcatgaggtcaggagatcaagaccatcctggccaacattgtgaaacccctctctactaaaaatacaaaaattagctgggcgtggtggtgcgtgcctgtaatcccagctactcaggaggctgaggcaggagaatcacttgaaccagggagatcacgccattgcactccagcctggcgacaaagcgagactctgtctcaaaaataaattaattaattgattaagttaaataaaattccaagaatctggagaggaccttctgaaatgtaagattataaacccaggggttcaaggtcccaaagttctgccacagtgtggataaaaaggagatattcagtatcttggttatagattataatgggattattgtccttcagttggtggaccattaaaagctttctttacctggaaaaaaatatgccttggcataatgcattaaagccttgctgcattaaaccacatcacaatttagtaacagaaaatacatgcagttctattattaagtgaatggaccttccaatgagtatttcttaagggtcaactgatgttgtccacactaagtggatcagattgtcatcaatctgcaatacatttgaccaaggtaatccagtcaattcagttatccttgcttaatgctgtagcatctgtaataattcattttacagttttacaacttttccagtgaaataagtacttctatcattgaaggttttatcagaaatgtccaatgaaaaaacatattttctaataacattttagttactgttgtaacatcagccttcttgcatgggaaagtttttatacaaccagaaaacatgcattgaaaatgacaattgaataaaacctgtgtacaaatgtttaaatgacccatcaggtttcaaaaatatacatgaagttttaattgtcttcctagaattatagatttgataaaccaaacaatggttataaactatgttagcaatttaaaacaatcaccatacatacatgacacacacacacacatttaatttatttaatttggattattttttctcttccatgagtcatgaaatgcagagcttttaataataaaagccttgaagactcaggaaaaaccaggtagctgtctagcttctccacaagttcatgtttaacagtggattcatgtccttttaaataccaggtttgtttctccaatttagatgcatagcactaataactgatggcttatcatagggaatttgacttgaaccacagagttcattcaaattgcatatctaaacaatctcagcactggctagtttagtatgaaaatctggcaaaacattttcttggtattcaattaatttttgtctcgctttgattaggagttttataagtcattcccttcattagagttctgagggttgttacccagtccaaatgatacaatcctaaagttatctaaaacctgtatgcaacatgtctgggttcttaccactcttttcatgacctccttaaagacataacactctaatattttgtgtgcttgtgaagtttttagaaactgcatcagaattaagtcagtaactatagatatgacttaaaatggtcatacttaaatacacagttggtggctgggcgcagtggcttatgcctgtaatcccagcactttgggaggctgaggtgggtggatcatttgaggtcaggagttcaaaaccagcctggccaacatggtgaaaccacgtctctactaaaagtacaaaaattagctgggcatggtgataggcgcctgtggtcccagctacttgggagggtgaggcaggagaatcacttgagctcgggaggcagaagctgcagtgagccgagatcgcaccactgtattccagcctgggagacacagagagactcaaaacaaacaaataaacaaaaaagatacagctgtcagggaaatttggttatatctgtggcctacagtaatttatcaaaataaccataattataactgatagtgtacattcagatatattagaactttagaaattccacataattttggaacaaacattaataacatatttattaaaagataacttgaggcctagcatgatggctcactcctgcaatcccagcactttgggaggctgaggcggtgtatcacgatatcaggggtttgacacaagcatggccaacatggtgaaaccccatctttattaaaaatacaaaaattagccaggtgtggtggcacccacctgcagtcccagctactcaggaggctgaggcagaagaatcgtttgaactgaggaggtggaggttgcagtgagctgagatcgggccactgcactccagcctgggcaatagagcaagactccatctcaaaacaaaaacaaacaaacaaatatatataagtatgtatacacatatacacatatatgtgtatatacgtatatacacatatatgtgtatatgtgtatacatatatatatttgtttgtatatgtgtatatacgtatatatgtatatgtgtatatacgtatatattgtatatgtatgtgtatatatatataacttgaagaaagttaaacatcattattcatttgacaataatttccatgtagtttaacatattctgtaatcccatttacctcttttttggatgctgcggggtccctctgtaacatcccaaagttgagtaaaagaaaagacaattttggagctcaaatttgatgttgggaagcctgtcaaatatgtcaaaggtttaaaacatttgactaacatatgatcaaaggtcatcacaaaataacagtcattcatgtagccgaaggaataattaaaataatttagggctgagcatggtaacttatgactgtaatcccagcattttgggaggctgaataaggaaatctggctgtcctggtttgagcccaggagttcaagaccagcctgacaaaaccccatcagtaaaatatatatattttttactatatataaaaatatataatattatataatatatatgaacataatatatataaatatataaatattactatgcatataaatatatatatatgggtgtgtatatatatgtgtatgtgtgtgtattttatatatatatataaattagctgggcacggcggtatgtgtctgtggtcccagttacagaggaggctgagacgagataattgtttgagcctgggaggtcaaggctgcagtgagacatgattgtgtcactgcactccagcctgggtgacagagcaagatcctgtctcaaaaaatgttttcaaaaaacaaaacactttactctttgatagaggagactcagttttccaataaacagacttgagaaaaacagcgtgaaataaagtctgtcttttctctactctccttttcgtttactcaaaaggtgaacaaaaatatttgctttcttttattaataatacatatcaatacaattttgttcaaaaatcaaagtttacttttatattagtttatcaatactaaagctatttttaaataagaacttataaataaatctatcaaatctgtcatcttttgaccacactagatttccatacatttttataatttcttgtaattaaatttcttaaactttttatattttagttttatctgcatcctttttgtgcttttaatttgaaacaatcttttggtaactttaaactgttaccagatgatccagaccccaaaagagggttcttggatctcatgcaagaaagaattagaggcaaatccatagagtaaattgaaagcaagtttattaggaaagtaaaggaataaagaatggctattccataggcagagcagtggcattgggctctggttgcccattttatgataatttattaattatatgctaaacaaagggtgaattattcatgagtttcctgggaaagtagtgggcaattcctggagctgaaggttcctcctgtttttagaccatatagggtaacctcctgatgttgccatggcatttgtaaactgtcatggtgctgatgtgagtgtctcttagcatgctaatgcattataactatcatataatgagcagtgaggatgaccaagggttactctcatcaccatcttggttttggtgggatttggccagcttctttaacacatcttattttatcagcaaggtctttgtgacctctgtgtcatgcagacctcctatctcatgctgtgagttagaatgcctaacctccttagaatccagccaaataggtctcagccttaaaaaccgagtctgtggtgcctcctttgtttttcccatggatttccaggctgttagagcttaaatagccacttttaattaagcttttaaccatagtgctctttaaaaaaaatcattttaattttttttttttttgagatggagtttctctcttgttgcccaggctggagtccaatggtatgatctaggctcactgcaacctccgcctcccgggttcaagcgattctcctgcctcagcctcccaagtagctgggattacaggcatatgtgaccacgcccagctaattttgtgtttttagtagagatggggtttctccatgttggtcaggctggtcttgaactcccaacctcaggtgatctgcctgccttggcctcccgaagtgctggcaaagtgctcccaaagtgcttgcataggaaagagccaccacgcttgtagcaggacaagacgcagacaaaacctctcagacaccaagttgtagaaggaagggctttattcagcttggagcatcggcaagctactgccttaaaatccgagctccccgggtgcacaatttctgtcccatttaagggctcacaacactaaagatttcatgtgaaagggtcgtgattgatttgagcaagcaaggggtacgtgacaggggctgcatgcaccggtggtcagggaggaatagaacagggcagggagtttcacaatgttcttctatacaatgtaaggaatctatgaataacatcagcttctaaatcataagttgatttttaactactgggtttaggccagccaggcccaggcctggtttcgggcctggcgcccggctgcctgtctttggttttacttccttgttctttttactgaatatgaaacaatataaaacaaagcgagagggtctttctctcctctcactcccagcccatttaaaatcttttatcacccgactttagccaggccaaatggccaatatttctgtgctcagtgaaaggaaaattcaagatcattggtggaggggaagagaatcaacaaatgataaaggtcatgcagatgtcaaactaggaagaggtcactcaaaccagaaaggagtcattccctaagctgggaatcaaacccgggcccaccattgtaaaacagcaaagccttcactgctaagctacagcactaggtggtttctattgctcttcccagaaggagtctagagtagcaaattttgagcttttaaaggcttttcactgctcaagataatttttagacttaactatgacatgaacccctgaattcctgttccctggaaggaggagaccaagagaaagtactgccacatggttacaaggtcaagttcccaaggacttaactgaccagtttgctggggtgtcttgaacagtggacttatggggccccaagctcatgttctatcctaagttacccatctttctgacagaaagatacagaaagacataatcatagcacaaagtacaacagatcggctacagcttaactagcctaacaaatccttcttctgattaatcaacactttacagaggagataaacagtgatgcttaccattcattcaatcggtttgcacagagagataaaggaaagggaagggagaaaagcattgcctatggtggggtggggaaggcaagaagctcaggggggccagagagagactcattcactgcagcaacactgaatcaaaagttcaggcagccactcatcagtgttgaaaagatcttttccagcagttccatcagctctcaagtttctcccttttggggaggtaaaagctcaccatgttccacaatcctgtacatgcctaatcctgtcacccacaaccatcagcagagagtgcaaggcagattaatctaaagaaaatagcagttaacatcccatagtgtcaaacccattcttagccaagagggactttactgaaagggtggcctctaaccccctaaatcgtaggaaggacgttaaccttcctaagttgggcctcaaacccaaggctggtcaagcatccttgcctttttttaagagaggcctttaacactctgtgtcttaggagagattctaactcccctaagttgggcttctaacccaatcccatcctttacctgggtaaatgcacctcacttacaaagtcagccaatcagtggtacagtctactttctttgggtcaggggtctcctcattatcatccctttgtggttcaccagaaaaatgttaccagaaacgggtcttaatctagaccctaaaagagggttcttgcatcttgcacaagaaagaatttgaggcaaatccatagagtaaaataaaagcaagtttatcaggaaagtaaaggaataaaaaatggctactccataggcagagcagcagcatgggccactggtagcccatttttatggttatttcttcattacatgctaaacagggggtggaaagtttcccaggaaaggggtgggcaatccctggagctaaggagtcttcccctttttagaccatatatggtaactcactgatattgccatggcatttgtaaactatcatggtgctggtggacgtgtctcttagcgtgctaatgtattataattagcatatgagcagtgaggaggaccagaggtcactctcattgccatcttggttttggtgggattcgaccagcttctttaccatatgcagttttatcagcaaggtttttattacctgtatctcatgcagacctgtctcatcctgtgacttagaatgcctaaccacccttggaatgtagcccagaaggtctcagccttattttacccagcccttatatgagataaatttgttctggttcaaacacatctgacaaaactgaaaaatttttttaaacaaacacatattttaatgcctttataactttcctcatcaaaagcacatcttgcttgtttgcaaattatgcagaattgtttgtcttacacattacagatgtacttatatttataattaattccattaactcttagtaattctcatttttagcgaaatccctagaaagcaattttgaatagttttgtatccatatttgtatataaaaattattttataattgtttaaagaaatgtgtcttcaatgttctttttactaacagatctaaatatactcagcttttctatatcacataaaaataagataccaaagcatataaacttaaggtgatatttaataattaatgttttagtattttaatgtacaaatgactttgattttataaacattattaaattaacataacatgtctttaagatcttaaattattgaaaaggattttgaaactatgacctgggtacattctctaatgtctttctcagtcatcctggtgaaagaagagaaaggccagggcacggtgactcaacgcctgtaatcccagcactttgggaggctgaggtgggtggattgcctgagctcaggagttcgtgaccagcctgggcaacattgtgaaaccccatctctattaaaacacaaaaagttagctgggcgtggcagtgtgtgcctgtagtcccagctacttgggaggctgaggcaggaggactgcttgaacccaggaggtggaggttgcagtgagccgagatcgcaccactgcactccagcctgggcaacagtacaagactgtgtctcaaaaaaaaaaaaaaaaaaagggccatatgcagtggctcacgcctgtaattccagcacttcgggaggccaaggtgggtggatcacgaggtcaggagatcgagaccatcctggctaacacggtgaaaccccgtctccactaaaataaaaaaattagccgggcgtggtggtgggttcctgtggtcccaggtactcgggaggctgaggcaggagaatggcgtgaacccagaaggcagagcttgcagtaagccgagattgcaccactgcactccagcctgggcgagagtgagactccgtctcgaaaaaaaaaaaaaaagaagaagaagaagagaaaggaaccaatcaattaagcagatatttagaacaaagtcctcagaaaaattccttttataacaagagagttgcctgaaagatcaggctgcaaaacagataagtaagtaaggtccaacattaaaaaaaaaaaatgccttctgtgtaatcagcaagtttcacatatatatggtgggcctcagtgaacacattcctttccttttgaggacatacttagataagggaacttgcacagtcagggggcttgcttggaacatgcctgtagttgcacagataagaggaaccaggcacatccacaatggaaaattctgtcacctaacatatccacagttaaggaaagttaaacaacatggaataacttagactaagagttcatgtgcatactagaaggacagggtgaagctgtcaggaattcgtgccttatgcaaataaaatacatacttctaaccggttttttgcaccttatgtaaataaaacatcctgccccactatcttgcccgtaaaagtctttgtattcggctgggcgccgtggcttacacctgtaatcccagcactttgggaagccaaggtgggcggatcacaaggtcaggagttcaagaccagcctggccaacatagtgaaaccccatctctactaaaaatacaaaaattagccgggcatggtgatgcacgcctgtagtcccagctacttggcaggctgaggtagaagaattccttgaacccaggagacagaggttgtggtgagccgagattacaccactgcactctggcctgggcaacagatcaagactccatcacacacaaacacacacacacacacacacaaacacatacacacaaaagcctttgtattcaactgtgaaatggcaaccctcttttgggccccctctccatggcagagagctttcttcttttgcttattaaacttttgctcccatctcacccttgctgtctgtgcttcttaattttcctagtcatgagacaaagaacttctggtgatacctcaggcaatgaggccatttcactgggtctcaaatagccattggcacacaaaatggctatgaaggacagggcctgattgaatcctaaattgaaataacaggtatgaagttcagcacaggagagggatcccacattttccagaactgtcaggaggcaaagctaggccagaaaaagggtcatattgcacttgatgctgccttcagctgatggtctaggcaatgagtgcttgtccccaggcctcaccatgttcacctatccagacccctgaatccacagactcaaaaccaaaattgtaagacaacagtcacatcaagcaagtatcaaagtatatctaactgataattttgaagccagttctatttaccaggaattttaaaacatgttttatttacaacatattgtcacatacacatagcacaaacacacagacagaagcagattttacagctttcatttaaaaattctcatttgctgacttttaaatacttttaatttccctattcaacatatcaatcttccaatttcctgcttctttgccctaaatgattgttagctaggcaactaatttgcatgtctaaaggaacaactcttgggtgaaacaagaacacttatatttttaaagcacaaagctaacactttagggaaaaatattggttttgtatttgctttttttcccaatccttacaatctgtgaaaggcaaaaatattgtatcattaactcaaaccaagaaaagtatggtgtaagtaaaagtttagttaagacaaaatagaaagcaccttaaacaaaggtataatgtgtgagttttaaaataataagagtttctaacgtacacaggcagacaccttacaaatggagattttcttaatagatgtaaatttcttttacaaaatgttttcaaaacaaccagttaaactccaagaagaggtgttttagtttaatatgtggtctttttaacttagctcctctttcctaactaaaatcaccgagtttagggtggagcccattaaagaacagggcaaagaaagcattctcttatggctggagtcaggaaggataaatctgaaaaaggtgtgagcctattttagctgagggtctacctttttttttttttttttttttgagactgagggcggctggagtgctgtggcgtgatctcgactcactgcaacttccactacccaggttccagcaattctctttcctcagcttcccaagtagctgggactactgacgtgcaccaccacacccagctaatttctgtatttttagtagagatggggtttcaccatgttggccaggatggtctcgatcttttgacctcatgatccgcccacctccgcctcctaaagtgctgggattacaggtgtgagccaccatgcccagccgggcctaccttttataaacactttatctaggataacttttttctcaccttcaggaagagcatagtttaaaagtgtagcatagttaattgtcttaccagtgattcacttaagccttttcctttgcctcttattgtctttttaaaaaacaatattgaaatctttttataagcttgtgcacatcaacagtcattcctagataagactaattagaaaaacctcattttcaaatacacctcttaaaatgcagtattgtttatttggaacattccattgtaatttcaaattacctttagtatgtttttgccatttctttaagaatttgctgcttctggggtctaatacttatatatgtaaatgtagccatagctaggaggtggattattcagttcttaagaaattaagaatcccatttttaccttgaatcttggctttggcactgttcttcttgatcaatttagccaacaatttttccctgcctaaggtcataagaaaaagaaacaaaagcactagaacataaaaaaactctgtcaatttccaaaaaccaaagtttatatgccctgtaatattgtcatttactattggttgatatctgacctattcagagaaaagggacctctaactggattccatccagttaattatcaaatccaatgggatcctgaacccagtcatatttctgtcataaatttctaaccaagtttggattagaaatttgctcaaacaaacttggagagctcaaaacacaaatccataatgctttgtgtaagagttaaagaaagagtaaagaaacacaaaatgcggctcaacagttagagacagatttatttttgagaaaatataactgtggggcttctggccaattttggtcaggagcactttctcttacagactaagagtatatattggttttagggtgagggtgcctatcacaagcttggaattcttctgtgtgagggagaagttttatggagggattgaaatgtctctgggtggaggggaggttatcttggggataacatctttctggccagagaggggttatcacaaggctggcgtcttcctggccggagggaggttatcttggggctagcatgtctctggtcgttgaggagtttggaatgtttctgtttggagatgttatttgtggtttatggttgtgctgaccttagccattaggctgacgccctttggatttaggcagtttttgatcaaggtgaactttagaatgaggggcttgtccaagatggcgacgctcctactctgtcaatccagacaccatagttataacaaagatgaggggtagcatgttctttctggctacttcttgctgatgaggggacagagagttttctggtctcaggttgactataggagcaatgccgtctgtaggtgtttttgcatagttgtctgtggaatggccacgatcctgccgtctgtactaaaaatacaaaaacaaaattagcagggagtggtggtgggcacctgtagtcccagctactcgggaggctgaggtgagagaatggtgtgaacctgggaggtggagcttgcagtgagcagagattgtgccactgcacttcaacctgggtaacagagcgagactctgtctctccattggtagagagacaaagatatgtgttggtgccacacaaaaagtacaggccttgtcgtgtatacaggcagagatatggaaggggaataagtgaactaaagatggagtgtttttcctttcctgtcattcattactccagatggacaaagaggaggccacagagacacctattatagtagaaacataggaagagttattttttacacacttaatttgatcagatgttgcaccattgatattgagccatggaaaaaggtgggcacaagggacagcacaagttatgcaggaggtattggttgagggagaggccataaaatgagccggacagagaaatgctccatatgcttcaagtgatatttggtagttaacttggttagtttgatggtcagggagtatttaaaaatgatagtatggttgcactggttaggtgttaaggatcctacagggagatttccctcagaggctgaaaagcaaagtgaggcatgttgtaaaaggtgggtgtgtttagttataggccctttaatgggagggccttggggcttgaggcattgcaaggagttgtaatagatttgaaataatttgatagcctgattggccctgcaagtaggataatcatcaacaagggtgtcagctctttcaaaaaaggaagctcctttttggaatttataaattagggttatgctccctcctgaaaggtcatgaaggggtgcgggaagggctgtgtaggctgaggaaaacagcgataagcacgtccagcattccagagcaaaggaagagttagcttgcagcaagaaggactgtgtaaggtttatagagtgttcaagcttgagagcagtgaggagtggttgtattggtgaggttgatttacttagggaatttatactgaaaaaaacaagcaaaaagagaaaaagattatttgggtaggagtaaagtcctggaaagttccttgaagccataggtcccatggaacagcaaggaggtgggctgggctcggtggctcctgcctgtaattccagcactttgggaggccaagacgggtggatcagctgaggtcaggagttcgagaccagcctagccaacatggtgaaaccttgtctctactaaaaagtacaaaaattagctgggcatggcggctggcacctgtaatcccagctactcgggaggctgaggcagaagaatagcttgaacccaggaggtggaggttgcagtgagctgagatcatgccactgcactccagcctgggagaaaagagcaagactccatttcaaaaataaaaataaaaaataaaataaaagaacagttaagaagctgatcaggttatataatgggagttttgtaggggtaccactgaaagtctgtaacatggtttgttaggaagtgatgaaagtttgggagagaaagacacataagtggtttatgtggatttttggggagacagacaggtcctggggagacacaagagaaggctgaagggattttatatttggttggttgggtatgtggtgaagggaattctgttttcttgagagcagtataatgaatccagttagggagtacctggagttttgctgccgtgggtgtggtaagaatgatttggtaaggtctctttcatttaggtgtgagggaggaattgggggtagggctgggatcttttaccaggaccaatctcctggctgtaggaagggattagaagagttggtgacgagttgtggcaggtatttgtcagcatatttccaaatgaaatggcgtatggtatgtagaagaggggaaacagggggagttggtagaggtggcacttgacccacagatggaacaaatggggcaagtggtctcccatacatgagttcaaaggggctgagcattaagggtttatgtgggagagcccaaatttttagaagggccaaaggtaaaagtgtaactcagcctttatgtgtttggagtgagtacctggtgaggtgttttttagagtgccattcattttctcaccctttcctgaagattgaggtcgagaggggatgcatagcttacaggcaatttgtagggcttgtgcaagtgtttgagtaatttgagagatgaattcaggaccaatgtcagattgaaaagaaagaggcacgccgaacatggagatgatttctgttgttaatttggaggtgacagtagaagcccatttgttggttgtggaaaaagcctcaagtcatcctgaaaaggtatcgaccagaactgaaagaaatcaaatcctttttactgggagcatatgggtaaaatcaatttgccattcctgtcctagaaggcgtcccctggcttgggaaagaaggaggtttagtgttggagtggggtgaagcatttcagcaaatagaacattgatgggaaatggcttttagctgttcctttatatctgggcttatgcgtatatgggagcttaagaaatattgtaagataagatccccatacaacagtagtttttcagggtcaggtaggactaatttgttttttgtttgtttgtttttcttttgttttgttttgagacagagtctcactttattgctcaggctggaatgcaatggcacgatcttggctcatcgcaacctctgcctcccaggttcaagtgattctcctgcctcagcctcccgagtagctgggattaccggtgcgtaccaccaggcctggctaatttttgtatttttagtagaaatggggtttcaccatgttggccaggctggccttgaactactgacctcgtgatctgcccaccttgacctcccaaagtgctgggattacaggcgtaagccactgcacccagtcaactaatttgttttgtatgaaccagtatgggggcttgaattgtgcccccactgtgactagttgttgtatttggtgttctggataaaagaagggatatgttgtataaagggaaataggtattgggggattggatgattggttgaggcttgttttgcccaatagttagcctcatgatttcctaacgaaatgtttttatctgattgaagtcctttgcaatggataactaaagacttttctggaagcaaatgatggattagttttccactaatgataggagttcccttagccataagatagccccactcactccaaatttgggcattggaatagatgatgttgtaggcatatttagaattggtgtatgtattaacttgtgtgctttttgctagggctcttattggggcaactaattctgcttgctgggagaaggaggatgtgcccaaaggcaagggggcagcctctatgacccttctaggtgggagagagtgagtatcatcatgatatccctcaatgatggcatatcctgcttggaggggagggttttttgatgtgctgccatctataaaccaatctggggctccatttatgtgagtggaagtaaggtagtgaaacatggtgagacaacttttcttttattttctttctttttttgagatggagtctcactctgtagcccaaactgtagtgcagtggcgtgatcttggctcactgcaacctccacctccagggctcaagcgactctcatgcctcagcctcttgagtagctgggactaaaggaacttgccaccacacccagctaattttttgtatttttagtagagatggggtttcaccatgttgcccagggtggtctgtctcaaactcctgagctcaggcaatccactggccttggcctcccaaaatgctgggattacaggcataagccactgcaactggccaagaactttcaattaaatcagagcatgagtggtggctggggtctaaaattcgtgctgaaggcaaaagagtggcggaactaatggggagcatctatgaagagagatagacagttgaaggagagttgcatgtaaggcctacatgagagaggatgagatggaagtgatcacattatggctgagcatgtcttgcagactgtaagaagaaaatacctgaaggggttcatagaatgtgaatttttgtgccttagggataattagagagggtatggacaaaatttttaagcaaagaggccagcctttctaaatggggtctagttgttttgaaaaatatgctaccagttggagggaatctcccacgggctgttctaatagtccaagggcctgattataagaactgtgtaaatatagatgtaagggtttcaaggggtttggaaggcctagggcaggggcctgtaataaggcatgtttcagtgagagacaacatgataacggtctggggtgggagtgagtgtttggtcaagctttccttttgtgtgttcatacaagggtttagcaataatggcaaaatttgctgtctataattggaaatatccagataatccaaggaaagaaagtaagtccctttttgttttagaaaaagggatttgttgaatgccttgctttcatgctggtggaattaatcgagtatttggagttatgattaatcctaggtatgatacttttggagaggttaattgggccttccttctggacacccagtacccacatttagccaaaaaacttaaaagcctggtagtatgttgattacaatgttctagagaggggctgcaaataagtaaatcatccacatactgaagcaagatgctaggttgtagaggtagctgggagaggtctaattgaagtgcctgactgaaatagtgagggctgtccctaaaaccctggtggagcacagtccaggtgagttgttaagagtagcctttgtcagggtcagtccaagtgaaagcaaaaggttttgagaggagggatgtagaataataataaaaaggcatccttgaggttcaataccaagaaatggctagtgttgggaggaattcactataggagggtgtaggggtttgggacaacagaataaaaaggaacaacagcagagttgatttgtcacaaatcctgaaccagtctataggaggcatccagctttttgattgggagaataggagtattgtggggcgaatgggtgggaattaaaatactggcagtcttgggaggctgaggcaggtggatcacttgaggtcaagagtttgagaccggcctggccaacacggtgaaaccccatctctactaaaatacaacaattagccaggcatggtggtgtgcacctgtaatcccagctactagggaggctgaggcaggagaattgctttaacctggaaggcagaagttgcagcgagccaactttgtgccactgcactccagcctgggtgacagagtgagaccctatctcaaagaaaaaaaatacttgcaaccaaaacttggaatatgatgggcttgagtccccataatccattagctttgaggcgatattgtggggccactatgtagcacttaagatccttcactgaaatttaattggagaatgatggacagctattatgggggagttggcgttccatactatgggatttacctggctgatgaatttgggttttaagactttttgatgtggagtgtctgaggaggggttttgtttttgacataataagttagggtggctttgatgtagggccaataaatgaatgattccccctagtttgtgtaggatgtcccttcctagtaaaggagtgggacagtgaggaatgaccaagaaagagtgtgggtggttccctgaaataagcagtataggggcgtggggttttgcgtggggtttcttgtatgccctttatgccaacaacagaaatggatgaacattctaatgggccttgatatctggttaatactgataggctcaccccagtatccaggagagaggaaataatcttactggatactgtaccaattaccctgggttctgtggactcactggacatgggagctaaggatcctggtcctcaatggacatgggggccaaggatattccattgtcagcaccagcagtgaagacatttcctcctgtgacagtcagggggcctgattatgagctgcatccaaatggggagggtgtccccgttgggggcagtccattttccagtgtccccaaagactgcaagttgggcacggtttgttggaggccaggggttagaacaagactttgttttaacatctttattgccacatacaaaacagactcctggagaggtgagggagtttcccttggggttatcggggggcttttgtgtaactgacttttggacagcagaagcgagcatctggcattttaaccagagatgtttgtctttttgaattttttgttcctcatctctgttgttaaagacatggaaggccacatttaggagatcccactgagatgtttggggaccctcccctaatttttgtaatattttctggatatctggggcagactgggaaataaattggaggtggagaagtttgcccttctctagattctggatccagactgatatattttagcatggcttcagtgaggcatgataagaaaatggcaggattctcctaggtctcctgtgtaatttctctgagtttttcgtaattaactgccttatgggcatttttgttcatccctgagaggagacaggtaatcatgtcgtcccttcacctgatgccattgtctccctgttggtaagtccaatctgggtctctatggatgattgcatcattggccactggattttgtatagcggctttgttatggagttcatctgtgtgggcttcagctgaacaccagatatgctctttttcatcaggagtgagggtggaggttagaattatataaatatcatgccaagttaaattaaaggattgggttatgtgcaggaattcccggtgatcatgggaggggttttcagagaaagatcctagatgctgtttgagctgcgacaaatcagatatggagaaagggatgtgaacatgagcaatgctttcaaccccagccagttactggagaggaagaatggcagaggtggtttgagtggtagtttttgaacaggtaacaggtggaggaggaggagtggggtctggtgctgaaggcttgggggcaggaggggccactggggcagagggttcagtcagtcaaggagcagatgcaggggatgggaatatggggggagttcatctgccaggtcaaaaggggtttcagaagaaggggttttgatggaaggggttttggaggaaggggttttcagaggagggagagacccggggagggttttaattgagaagaaggattttatgaggggtgcaaacttgacatagggagggtcaggatctaaagttgaagaaagcctgaatatagagaacctcttgccatttgctattcctggttataaagctgtcaaggtccctgagaatttgaaagtcaaaggtgccatttttgggccatcagctgtcattatctaatttttattggggtcaggccatgttgcaatgctttggctaaagactaaatgctttggcttccccagaagccaactttggcaaggttgtgaaggagacagcccagtggagaggatgtaggaatgtgtgattgtttggcacccatgtagactggtgagaagaagccgagggtgtctgtttttgttctaggcatccccagatgaaagacagagacctggagtcctctttctaaagagaatggtcaacctgagaagaaactgggtgtccccaagatttcttctagcttagtcccgctggtcctccaaggaccaggatagcagatctgactttcccaggtaccgcaagaaagccaggggaggacagatcttacccatcagctggatgactatctgatgttggatgttctggttggaataggcaaagggcctctttgactggagctgcacgaggaagacagacagagagaagggaggatgagggaggaagaggagagaagagagcaaaatacccattgtggccagtcagaggttgattccggagacctgagggtttagagaacttcctggggaatagccccagccagagccttgcagtccccttcaggttagttgtcctcctcttgcaaatcggtcaaaaagtgaaatgacagaaaagatggggtgtgtggccagaaaccctcaggatccaggaattaactcaggatgagctgccactgcccactgcttcctgggttgcaagagactctctgtccccagaacccatcctgggtttccgcaccaaatgtaagagttaaagacagaggaaagaaacacgaaatgtagctcaacagttaaaaacagatttattttagagaaataaacctgagaggggcttctggacgatttcggtcagatgcattctcttttacagactaagagtatatattggttttagggtaagggggcttatcacaagcttaatgtttctttgtgggggataagttttatggcagggttggaatgtctctgggtggaaaggaggttatcttgaggctgacatcttccggccacaagggggttatcttggggctggcatcttcccagccagagggggcttacctcggggctggcatgtctctggttggggaggggtttggaatgtttctggtcagggatggtatttgtggtttatgataatgctgaccttaggcattaggctgatgccctttggattcaggagtttttgatcaaggtgaactttagaatgaggggcttgtccaagaaggtgatgctcctgctctgtgaactctcacactgacatagctaatattgtctggtgattttccagatgacaaccgctctcctaaaaaatctaccaaaggaacataatgatctcagtttggataaatggctgacaaagagacaccatattgaaaatgaaatataatgctatcatgaaataacggctttacaataaaaatttgacaatgatagagaaagcacaaataagttccacaaaactgaaagggacttaagcccctacctttgttggtcattcatgcataatgaaagataattctgattagattgctcttctctagaaaaaaagcacatggctagttactgttagtaagttttgtcatcaaatacagtatgaatcgtgggcatcatctttccacatatgaagaacactacaaacattctaagggtctaaattataagaaaatacaaatagactaataactccatgaaataatcataataatgcagcaatgttgcattcactaagtaaccatttttgagatcaagatgttactctttcattatagatatgggaatgcagcactgtcagtggagatgtattcctgtaagaaatacaagatatataataaaatatatttgtagaaattctaatatatttaactttaattttagtcacccatagttttaatcaagtaaaacagatgccaggagatgaataattatttacctttgtcaacataactataaaaggaatactaattctcactatttttctgtttgctccattatatttgaacattggataatgtttgatactctgtgtcctactcattttcttaaattttatttaaaactttttttgttttgagacagagtttcgctcttgtcacccaggctggaatgcagtggcatggtcttggctcactgcaatgtccacctcctgggttcaagtgattctcctgcctcagtctcccaagtagatgggattactaggtgcccgccaccactcctgtctaattttttgtatttttagtagagacagggtttcgccatgttgggcaagctggtcttgaattcctgacctcgtgatctgcctgccttggcctcccaaggtgctgggatcacaggcatgagccactgagcccagcctatttaacttttaaaactattaagttattaaattggtttacaaaatatctcaacacaattgcaatttattgtgtatctcatgtttcaaaatccttcccttagaaagacatcaaaatgatttaaaatcaaaatatgtttcacaaaatatgccaacacaaagtattgaataattgactctgtaataaacctaataatgaatgagtaaattacaaaaattttatccctagctagtggtgacttctaaaggggcaatttcagtaaaaattttaagttcaaaaaaatagtatctttaaaaatacaacgaagacatgaaacttggaacttctaagttaaaaaaactgttgagacaacatttttcagaccagaatataaaatggtttctttgatttttattccctcacaatcatggagaatcaaaccaaaaataaatatagaaattattcaagaatgtcagatctttttgaaattatttttataaggtagatgtaaacaaataaaatatttgtttttgtaaagggggttacacaagttttctttagactataaataacaagaaagcaggaaccattttctacatatgttccaaataataagtgctattaagtgctcaatcaatatttcttcaataaaaagccagcattagtatcaagtgctagaaataaaaacaccattaaaattatttcaatgaatcatcttgaaataaaatttaaagaactatcttttttggctgtgcgtggtagctcatggctgtaatcccagcacttttgggaggccgaggcaggcagatcacctgagatcaggagtttgagaccagcctggccaacatggtgaaacctgtttctactaaaaatactaaaattagctgggcgtggtggcacatacctgtaatcccagctacttgggaggctgaggcaggagaatagcttgaaactggaaggtagaggttgtagtgagctgagatctcaccactgcactccagcctgggcgacagagcaagactccatctcaaaaaaaaataaataaataaaaaccaaaaaaaactatcttttttgctgtggtgattctttatcaggtaatgcctgatgaggcataaatgaccaacacaaaacattccagactggaaaaattcaattaagggaaacatttttttccttttaaagatgttgtaggacttttccttagttcagctaaagacagggtccttgtcacacggtcatgaaatattcggctcacagacactttgaagggtgagaaaaatggaatttattaaggataaagaggaaccagggctcctcagcagtacaagagtcctgctagcataggcttcctgcttcacagattgaattccaggttccactcaggaagggaaggggccaggctccccccaccgcgagcttcccaaggctccaccccagtgcacacccctcccagtgtgcaggccggtgggaggttctctgatggcccctttttactcagctgcctcattcctccctctaaggaagtacatctaactaccgttagaataaggatactgcttcctgctatcaggagcagtctggggactcaactgtcccctcagaggcctatctaagggtccctggcagaaggggccaatgtccaaggctccagctacctgaccattcaaagtctgatggctgaaggggagaagagacacagcaggttattagaaaacatgcatcaaaacgaaacaagaggaggggtaaggacagctcaaaagtcccaaggcttttcaccagtttgcacacggagagggaagccaaaagcccaactggtaaaacaacaacaacaacaacaacaacaacaacagcaacaacaaaacttgaactttttgccagcatattgggcttctgggttcccttcccctgagcccagtgctaagccaaccagtttaaggtttgggaaattaactttttccagtatggagaatgcatctgaggaaagtgtcccatagtatggagacacaactacctatctgtgaagagaggacagaggaggagaaaggaaaatatgtttttatcaaaggagtcccagtgtttcagcatgcattcgaaagggtcacagactgaagatgaatggctacccatttagaaagaagggagcaggcgtgcctggttcccttctcttcctagcagatatacctgtggtatgtgagggagagaaggaagagtgtcccctttcccacttccatccttggatccctgagtgctggcaaccttggcagatgccacccataggtgccaaagcagcttgcacctgtgaagcagggaggacctagagaataagaattatctactctcacccatgtctctaacccacctactctcagtagccttggcgttccctagacctcatttatgccatggatactactcatccatgaaaaggaacaaaataatggcattcatagcaacgtggatgaaactgaagaccattattctaagtgaagtaactgaggaacagaaaatcaaacatcatgtgttctcactgataagtgggaggtaagctatgaggatgcgaaggcgttaagaatgatacaatggactttggggacttcggggaaagcgtaggaagcgggtgaaagacaaaatacaacacattggtcaatgtacagtgctcagataatgggtacaccagaatctcagaaatcactactaaagaacttatccatgtaaccaaacaccacctgttccccaaaaacccatttaaataaaaaacaaaaataaagagacaaaaaaatttaaaagtctaggatagggaaaaaaagaggtcttatgaatctataagacatacttctgtcagcgtgcctaataggtttacgtatttatgtgttgtgtgcacaatgtttctctactataaacagagagctctaattcgttgtcttaaagaaaaatacaagtgcataaatcaaccattttatcaataaaaaagactagtcaaatggtttttcaagttcatgtgacttaagtcacatttaagctggctttcaagttattggcaaaataatattagaaatgttgtaagaattattagcatttttgtttgcatttgttgatcaagtgatttcatgattattcctgaagaatactggaagatttgccataagggttataaaagtataaaacccagcccaagacagaatgatctttgcttgtgtaatttttgataaataggacatggaatatcttggtttaatgaaaacagctaaattctgagttattggtaaaaatacccttatatttaaccttaagagtctcacttaaataaacatctgaaattcacagctataaaaatgattaacagggaattcaatttaaataatgactatcaaagttttcataaataatctaggtaaagggggggcaaggtggctaatgtctgtaatcccagcactatgggaggctgaggcaggcagatcacctgaggtcaggagttcgagaccaggctggccaacatggtgaaaccccatctctactaaaaataccaaaattaactgggcacggtggccgggcacctgtaatcccagctactcaggaggctggagcaggagaagcgcttgaactggggtggcggaggttgcagtgagccaagatcacgccattgaactctggcctgggcatcaagagtgaaactaactcaaaaaaaaaaaaaaaaagcctaggtaaaatattaaataatctggtaagtgtaatggactaaatgcttgtaaagagacttgccatacgattagggatctaagattattagtagatattaagtaggtaatttccaacttaaaaacacaggaaaacattttttaaatgttcttattaaaaggtaaatatctctgtttaattcaaagcttctttaaaagttatgtataaaacaaggtaaaagaaaccaggaaataagagatgtaagaaagttaaagctataaagaggcatttttggtaaaggtgaaaaggaaacaattttacataagaagacattttgtgtggtaaattttttgtcctaaaatgactaggttgttcaagaaagagaaatatttaggcaaaacagaaagtttaagcatgttgtgcatcatctacataggttgtagaaaggttagttaacagaaactttgtgttttttttagaaaacgaggttgtatacttcagttgggtgtgattaagaattataatggtctttctagaggtgggtctttgatattaacaaaattacatgaatacaaaaaataattggttaaaacaagattttatttaaaatatttattttttatgagacagagtctcactctgtcaccctggagtgcaatggtgtgatctcagctcactgcaacctttgcctcctgggttccaggaattccatctatatttctgagcaactgtccataaatcatggacttccataacccccttgctcaagtttaataattcgataaaactactcacagaacttagcagagaaactttacctatgtttatcaggttattatataggatacgactcaggaaaaccaaatggaaaaaaaaaaggtataggacaaagtaaggcggggaaaaaatggggtgggtagtaaatcttgataaacagccatgattaagaaccctccatcctttgtgttctgtaggaacagcttactgaaaataaatacccttttcattatgacttagatgatgcttcctcttttagatatcataaattcacagactctctaaattctcatttttctctcataaacaaataattttgtcttcagtgttcagaacaaaatacttgttaaacaaactttgcttaagtttctctcctttcctcaggctcccagactctggtccaccttcagtctgagctaacatataccccacctttatgcccctcctaagaaaaggctgactttagggtggaacattctctacccttcaatctgattttgccattctccattctcctctctttctcccaccttccttctaatcttgtttgctcctccatatgaaactgtacagtccttttctctcttgagatgattgtagatgtgatgcttggtgctttccccattgcaatactcttttcaaataaagtcacttcttacctacatctgaatttatttgacagtatcaagaaacagcctcaggataataacaattacaccctcacagaggacatcacaacccgcctcccatctcaactctcacaatgtctgcctgtggattcccagctttccagggctctgtagcttcactcagtataaaggctccttcaatggctgctctgagcaggctgggatagctccaggggaagctccccaggaagatatgactgtgctattcatgaactcctttgacaggtcaagattggccttagcctgcagtcaacgggctcatgtctctgatttccagtcaaggttattcatttagtttttctttgttttgttttttgagacagagtttcactcttgttgcccaggctggagtgcaatggtgtgatctcggcttaccacaccctccgcctcccgggttcaagcgattctcctgcctcagcctcccgagtagctgggattacaggtgtgtgccatcacgcctggctaatattgtatttttagtagagacggggtttctccatgttggtcaggctagtctcgagctcccaaccccaggtgatccacccgcctcagcctcccaaagcactgggattacaggtgtgagccaccgcacccacctacagaatagatttatccactgtcacaaatactccactgtacaaaaagagaaactaatttttttttttgtaaatcaccaattgacctaccacaatttcttgtggaactatattaatttctctgcaggtataaaggaaaagaatttttccttctcacccagtaatatccctaaaactaagctctgagattctgcttgaaaccacccccagaaggtacagacctcagatatttattacacattctcaggagaagaacaaataaaaataagaatttttaacaaattaaatatatcattagattttttgtgatagtcacttttttttgagaatattttcctatctttcaagatctgtcaataaaatgcattgaatacttaataaaaatgcaagttgaaatgagaaaacaagtcttttcaagatgacacaccctgaatgcaagttgaaataagaaaacaagtggcagtactggctggaatattaatacacctgattctagtgtcaagtcatgatatcccatcatatggatcctcccacctctattctgctcattgaagtactcagtgaccaccctctggagagcctcttcactgtggccctgaatgtgcctggagtgcatttttctttgcaggtcattgcatcatcttgatagaatggattttcattgtctttggggatagtttttctcccttcccaattctgaaaaaatccagatggtaggaattatttctgtctttcccctaagtatcaccactcaattggctgaccagcaatgtgtctccaagtaatgaaaactggggttggaaaaagaaaatttttatgccacaatgagttagctttttagataaagggtaaagcagatttacaatcatctaccagtaataatttgaagattcaagttgattatctacaaataaaatatcacaggctctgatgtgtaagttctggatttaacatgacagtgcatacactgcatgggacaggtactatacatatctggacaccacaaagagtatttaacgcctgcatttaaactactgaattagcatgtacctcacttggctcagtaatccacctgcaccaaactcatatcaaaagtcactaaatctctcgtctacattatatatattctgtagatacacaactacaaaatgtacatactatacaaatagtttgaatcaacatgaagttccattgtttttgacaatgtacccacagatggacattatcatggctaaaatctatataatatagatgagattataaatctaaggttttaacactaacaaaagacaacccagagcatcttggtaagtcttgtttttattttcttcctgagagtcagtagaatggcagctgtattttgttatgttagtcccatatatttctgttaactttattatttgcaaaaaaagttttgcttgtatttgtagaaaggtaaaatggttttttttgttaaatatggagattagttatgtatgataaaaacaaatgtgcttttgtttctttgttcccaattaatgtacattaattttaaaatgcattaaagcaatagcaaagaaaataaagagatgccatagaaatctctttctcttcatgtttgcatgcagagatacactgcttcctaaggatatgtaaggagagatgtggattttaattttagaatcagatttttcaaatgtacttaaaatataagcagcaaaaattttattaatcttaaactcaagcaaattccaatcacagaggcagaactaattaaaacatgttttaattgaatatacttcctaggtttctcctagcaatcctgttattgtttcatgatccacttgaagaaatgaagatacgtggaaaaatagtcattgcccaagattgccctccattttataaatgctccatttatgctgaaacaatctgaatagacacggtgctttttgtgcatctggttggaggacagaaactccccaaacttttctattcagctgttggatccacaacttgctgttgagctgtaaatccacatcaggaagcccaggtacaaactgagagttggcttctccctggtaatctaaacagatgcttactgagcctgaaatgctattttcccaccaccttctgctgactgctgctttggcaaaataaagattggccacgaatctaccaacaccacctcactttaaggcctggtatgtcagcattctccatcatactctgagacatagcatgtgggagacatgactctgtaattaggagcttaaagtgtttcagggagaccacgtaaatctagtgagaagtgaattagcaatatatgagagcatgtaatttcatgttaaggcgggtgctgtgaacttgattacattagtatgtaagttaaagcagctgggagaggcagaccagaaaatatagttgttgagctgagtcttgagagaagggcaactgcaccttccaccttccgcgtgcaggactgtcatcagcacatcttccccatgctttcccattgctcatattcctccagtggaaaagaagggggccaggcacggtggctcatgcctgtaatcccagcatggtggctcacgcctataatcccagcactttgggaggccgaggtgggcggatcacgaggtcaggagattgagaccatcctggctaatatggtgaaaccctgtctctactaaaaatgcaaaaaaaaaaaaaaaatcagctgggcatggtggcgggcgcctgtagtcccagctacccgggaagctgaggtgggagaatggtgtgaacctgggaggcggagcttgcagtgagcccagatcgcaccacttcactccagcctgggcaacagagtgagactccatctcaaaaaaaagcaaaaacaaaaaaacaaaacaaataaacaaagaaagacagaaaggaaagggcaaagttcacatgctgaagcaagagggactgccagacttagaaaggtggagaaataggtgggcccaggataatattggtgagaaggctgcttttggttgatttagttacagagcttttgagctcatcatgaatagaaatagggttaatgcagagcggctataagcatagacttgggagccaggctgattgggaatataagtcccagcttcaccttttatgagctctatgatcctggacacttcacctcttattattcagttttctcatctgggaaaaacagataacagtacttaaatcctaggattcagaagagttcaaggattaactcaggttaagataagtgaaacaagggagaagcaactgttcagacaagaaataaaaggaaattgacaaggatttccatttgaatctaataatcgtttagggtatctgttacaattttagattcccaggcctcagccccaggaattgagattcattagttctggggcccaaaaggctgttttataaaaagaaacttagaaaaagtcaccaaaataactcagtttctgtatgcccttaccagttccccactaatgtgaacatctcgtgttgacatggtacatttgttaaaactaaaaagtcaaggttgacacattactactaactccagacttcatcaggttttccactcatgttctttacctgtcccaggatcaaatccaggataccatactgcatttagagaagctgcatttttcacaagctctttcagctgctaagagggaggtgggtggggatcacatcttgaaaaacactgggaccgttacaggaatgacgcaaaattgctgcatccccaagttggggaggtgaaatgcaattttgaagaggagaattggtggaggagatgaatatagaaagctgattttagaggtagagatggaatcctctccattagatgagagggtgttaccttcagaacaaggcattaatgccagagaaaataggttttggaaggaagaggtacaacctcatattcaggctagattgagaatacacgagtagggttgtgagtaggtcagaatcagcaagtgcagcaaactgggaacaggtgtttcagagaacgcacacagagggctcacataagggaattacaaggggtcagttagctcgtgagctacatacaacctgcatgttccagaacctggtgctaatgctttggcagtgggtcacgatgacaaatatcaagcactgccacattggaaagtagtagaaaaggtaagggtgaggctgggataatcaattttatttaaggagggttctaagggtcttgggtgaaacaggggctggaagaagaggtgtataaaacacttgaagctctgcttgtgagtcagttgtcacactgaggagacacaggagtcaccagcttgaggtgacaggtaaaggtttgtagaattgagaaggtgaagatgaagcaatatatttttttaagaagcaagcagcctattttgggaatccatggaggtcttttgaagtagatactactcatattttactaaagaccttaggttctgggactatcactgagttttcttaatcacagtccaattgctcagcttcctaacaccagttataaaagtcacctaacctgttcttttttagagaatgttaaccattttccaatggactcaagattcttataatgtctataccatttttctttcccagttagttgttctttctgtaccctagaaatcctaaaccacaagctgatattctttaaatttcacattaagtacatgttctgtcacttgccaaatgcatttaaaagagttcaatagacgcaaggcgcagtggctcatgcctgtaattccagcactttgggaagccgaggtgggtggatcacagggtcaggagttcgagaccagcctgtagtgggcacctgtagtcccagctactcgggagactgagacaggagaatcgcttgaacccgggaggcagaggttgtagtgagctgagattgcgccactgcactccagcctgggcgacagagctagactccgtctaaaaaaaaaaaaaaaaaaagatagacttcagtagaaattgccttagaaacctgtgtcctatggggcaggcttctgaagggctcctagatcttttgcgttgctcgctggcacattgttgggcccaactgggtaataagtgtctggccattagacttaaggtcatctaatccttaacttgatagattctgggtgttctctacaaatttgcatagaaactagcacttacctgggagatttctctgccagctgtcaaaaatgtagttccatattcaacggtcctgtgtgaggaaataatgaagccacagaaatcttaaatgtggttagggaaagggctgggtgatgaagattctagctaaccagcacactgcagcaaaattagtttccagaaacactgcataacctgaatacagaatcaagagtaatttggcttttggttaagattggctttggcatttttttttttttttttttccgagacggagtttctctcttgttgcccaggctggagtgcgatggcgcgatctcggctcaccacaacctccacctcccaggttcaagcaattttcctgcctcagcctcctgactactgggattacaggcatgcaccaccatgcctggctaattttaaatttttagtagagacggggtttcttcatgttgaggctggtctcaaactcctgacctcaggtgatccacctgcctcggcctcccaaagtgctgggattacagacgtgacccaccgcgcccggctggcatgttttttttaaaccaaggaatagtgtatttggaagtgtgggaaaactacatcaaaaaactgaaccttgagttgtaataaaatcaggatttagtgttgcttgatttcagtgatatatgggcatctaggttacaataaaagaaatgtgaataaaagaccagaataaaatttctctagaaacattgagccctaagattagatagttcatcttggaataaactatataaaactgccaataggcaactgcttttgtgctacaaaaatggccatttcacttggctcaaatacatatttcagatctttgtcttttccttgtaatgaagatgtaaaagttttagttcacactataccagagtaaaatttcactggggtctgtattacaaatgttaaaataacccaaaaagtcaaagtaaatttgagctttggtactcagataatcgttttcatagtcttatgttaaagaacttatctttcccaggtatcaaactctaagaaaactgctatagttaccacctactagcaacttagtttccttgccccataacatttgtcagagaacctgcccagtttcagtgacatttatattcttattctaagttgacccaatttttcatttatctaaatgattgtattcccttctagaattcaagccaaaggacagaacaatgttagtgttccttattctattgatttactctttttttgagacaaagtcttgctgtgtcgccccaggctggagtgcaggcatgatcatggctcactgcaacctctgcctcccaggttcaagcaattctcgtgcctcagtctcccgaggagctaggaccataagcggttgccaccatgcttggctaatttttgtatttttagtagagagggggttttgccatgttggccaggctggtcttcaactgctgggttcaagtgatctgcctgcgtcagcctcctaaactgctgggattacaggcgtgagccagtgcacccagccctgacttactcttgaagtcatgaatttatgtccagcgtccctctgtcaaactggtttttaaatctttgaccactcatatatgtcaggacttctacttagttaatggcatattataaggtgcaaaccatcttataaacaaggattcatcatacactttttcttctaagtttaacacagatcattgattctagtttgcaatttatcaagataaggtgataagttgaagattttaccttaggtgctaaataattaaaatggataaaaatacaccaatattatcaggatttagtgaggatcactgaagctgagtggctagaattttaattctaaaaaaaaaccaacagtgatttatttttaactaaaatgtaaacttgaaaacagtgtgctaaagtcaaattatgtggtttaagtcaccctctgtacagcaactttaaatctactttctgtacttccattttgtttctgtgtaactgaaaacttcaaacactctcattctaattctacactattcctggaaatcctttctctttgatatatttatctaatttcatattctaatgtgtttttcctttcagacacaacaatcaactactcaaagatgccatctaatgcactatgccactaagtattgtggccagagagttattttaagtgtaataaattatcttaaaattgagggccgggcatagtggctcatgcctgtaatcctagcactttgggaggccgaggcgggtgaattgcctgaggtcaggagttcgagaccagcctgggccacacagtgaaacccagtctctactaaaatacaaaaaatcagctggccgtggcggcgtgcgcctgtagtcccagccactcgggaggctgagacaggagaattgcttgaacccggcaggcagaagttgcagtgagccgagatcgcgccactgcactccagcctgggcgacagagctagactccctctgaaaaaaaaaaaaaaaagagaaaacaaatattacatcttaaatacaggcatgaattaaaccaacttgtgtatggtcaaggcaacttacaaaaatgctttaagacatatcaagactgatataaaccatttaagttaggcagagatgcaacactatgtgaatagaagtgttataaacacactcgccacattttaattagtttactaggttttcttttaatataaacatgagaaatgaaaaccacatcaattgtagcatttattttgaaaataaaactgcaatcaatactccaatctctaagctctgcattccataaatgatactttttcaggaggtaggattcctaaggtttatggaagttctttttaaatagcaggacatgaaatatgatacctgcatccaggctaacatgtgggataataaaatgtattgcatcacctactactattagggtccaattccttctaatttgttacatatgaattaacatggatcctcctctttatcacatctagggaaaataatctgaggtgatcaatgcagataaaagccttgcaaagagctactttacaagagaaaagggcactttataaaaacacaagaattccaaaagtcttagtgaaattttaagctttgatacttgtagaagtaacaatgctacaaacatttacaaatcattgaaaagcttgttgtatttcttttacgtttatttagttttgccattttttaaagtgacagtgtctcattatgttgccaaggctggagtgcaatagctatttacaggcacaatcacagtgcactgcagcctccaaggctaggcctcaagtgatcctccatttaagcctcatgagtagctgggactacaagcatgcctagctcctgagtattaagcttttaatttattgtttcagtccttcttgaagatagcagatattgactgaaacaaaaggttaaaagtttaacattcaaattctgcaaaataaagccagaggcagtggtacacacccatggtcccagctacttggtaggctgacatgggaacattgcttgaggccaggattttcaggctgtggtgtgctatgattgtgtctctgattaatcattgcactgtagcttgggcaatatagtgaggcatcatctattaaaaataaaaagaagaaatacaattacactttcaaatgatattttgtaaagatttacagcatgtatacatatgctgcagtcctctggagggcccaggcacactatattaaagctaaaaactgccctgaaactttcaggacaccttgtattttattatttttatataaccactggaccaccatgctgcttggcactatgaaaacatctttgaatacatttacttaataagaaaatttatcagcaaatgagaaccattatagttcataagaaatacaccatagagcttcataaaagtagataatcaataaccaatactttctctttttatgacccccaaacatgctaaactgctaataagaagggcttacaaaggatacgaatggcaaatgttaattggcagcttttgcttgatgatcgccagtaactgtagcttccatggtaaaagtaggaagaaagagcccttccatacctgacaatgctgggactgctcctagtggctttaggagttgttagactcccatgttttaacagtgatactgcactgattccaaatgcatatgcaggaatattggggaaaagaaaaaaacataaaagaaacagaaaagttatctttaaaatctaaaaagttaaactattgttttaaaagccttacatagttcacagctatcagcccacacattaagcaaatatctgtacgtgggcaggagtcttcactttgaagtggtttttataactctgtttacattaaacaggacagaagagtgtaagagtgtgttgttgccctgacaaggtcccattctttactacgaagtgcaatcttagttgtccttgagttaacttgaattgaggtgtttcttctttagaaaataccaacttttctagttctttagcaggagaggtgatattttcctgtcttttttgatgaggggttcagatgttaaattactcctcatttcttccttcagaagaggatggccttagcacgctgaagatgaattaaatcatctgcactcagagacccattcttggcagcactgtagaaaactttgtcttgttccatccttgaaaaagcctaagaatgtcaaatagaaaagaggtacaattttaaaaaggtttccaatcttttaacaatcaccactgatgataagccacacatgcagactcctttagatagttcagttacagctactttttgttttttttggttttttttttttttgagaaggagtcccaggctggagtgcaatggcacaatctcggctcactgcaacctctgcctcccaggttcaagcaattctctgcctcagcctcctgagtagctgggattacaggcgcctgctagcatgcccagctaattttcatatttttagtagtgacggggtttcaccatcttggccaggctgatcttgaactcctgaccttgtgatccacccacctcggcctcccaaagtgctggaattatacgaatgagccactgcacccggcccagttatagctactttggctgaggtttacactgccaagttttgtcaactcattaaggtaatctcagggctagaattagattgctggagcaaaggggaacttgttttattaagttacttaaaaattgggctcccaaagatgtcacagtattgtgacaggcttctaagagcagtatcatgttacctgtgcacttgttccttaaacataatgaatgtacacttttgcaaaaagttagtttattaatctacttaaactctacccaatctacagtagttattatatactttaagcaaattttaacgatgcaggcatgtgctggattgtattgaaacatcaaagaagtctaatgactcaagcatcaaaaggcactacttcacttgtacattaattatgatagaaaatgtattattttaaaatacttccaaggtaccacaaaacatgcctattttaaatgttcatccttgtcagctgtaactctgctgtgtacttaccaaaagtcacaaaccataaatattactttgtctcataaaagttatcatttccagtaaaatcccatgtatttcctgcatccagtatttgagacgcgcacaccttatacagtctaagtgcaggtctcttggcttaggcactaatgctttgtctaacaaacccatgggactgactgcactgtggtatatacagtaggaaatgacataaatttgcaaactgagtaataaaaaatagtcaagagtggtaagtgcattatgtatgtagacattgcttggaatacaataaaagaaatcatttatatatgatgatttgaaagggtaaaagttcaaaagggaaagattacaaatgaattaaatttgactaaaatattctgaattatgctcacaaaagagaagataatatctataatttcaaataatgtggatctttgtaaaaaccataaaagatacaggaaacagaatgccaaaaaggtaataagctcttcagtatgttagttaattttgaagctttccatttttctaatcactacttaatatgacctagtcacagatgttggcattggtgtttgactgaaaacccaccttagtaacttcgtagccttacctccagcttccaagctctttctctgtcaagaagataaactggtgaatacaggccgttgttgtgtgccaaggtgcgaagatcgaagtagaatctgctataaacactgttagtaatgctgttattataattaattagcttcaagaattgcctttccaactcattcctggggaaggagaaacacaacaaaaccaacacaggacaatgttagttcaaaaacattattctcgtgtaagaaatgtggtaaagtcatcatgtgctctagtttattagaacacatgaaagaactcacactgtacagaaccctattgatctaagaaatacaagaaagcatgcaactttcccagttctctttgaaaacttagaaaaacaaaaaacaacatgaatgtaaaaactgggttaataacgcgattatctcacgtgctttcaaagacatatttgaatttaatatggagaaaaacgacttaatcttaagaaacatggtaaagccttcagctttttcatttctttgaaaacatgaaaggattcaatggagaaaacccttgtaaatacaaacatccatggtaaggccttcagttgttccagttccacatgaagaacagaactcatttctgaaataaaacctgtgaatgtacagaatgtggaaatgccttcatgtacatgatatttgctccaagacccatgataacacacactgtagacagaccttacaaatataagaaagcacactggattggaaccctagtagattaccaaattcagaaaagttttcagttttaacaatttcttcaacatttatatgaaaatttcccctacagggaaatcctctccgtgtttcgaaattggagagcctgatgcaaactgattatggcataatcttaaaaaatgtgcataagtaaatgttatactacttataaatattttgtttctcagtgattcttcatttgaaagggtctctgtccttacttccacttcttttgcaagaaaacactgaggtcaaaattttgtagatactccttaaacaatattaaatgaatttaataggcagtgtttttttgttaagtcagttaataaaatttttctctgtttatttaagaatatcacactgagctactagaatagctccaaattcttttttgaaacaaatacaggctatgcaggtggattcctacactaatgtccaaacagggcacagctgcttgcagtccattctgcatccagcaccccaagtttgggatgaggagaaaggggacagccttctctgcactcgtgcagctgactcagggctcattcttgagggttccattgcacaactcagactccatggtcactcccaaggcaccacaatagtgatcagatgacagaaatgatggatgccatttattagctgtcactattacggggcaggaatactctttacatttcagacggtagaaagatcaaagagaaacaccttggctagactaaacccattttatgacaagccttttggtagggttctggccttacacagtgtttctcctaagttggaaatgaaaccccaaggtgctcagcacctgtcacccctggccagaacagagtgtggggatgaattgaatgcagtgagaggggaacaggctgggagcagccctctgccaaatgattattcagctgtcccggccgaagatttttgtttgtttgtttgttttgagacagggtcttgctctgtcgctcaggctaaagttcagtggcatgatcctagcctttcaagtagctgggactacaggttcatgccacttagctgggctctttttttaaaattatttttgtagagacaggctctcacttgttgcccaggctggtgttaaactcctgtgattaagtgatactcccaccttggcctcccaaagtgctggtattacagacgtgagccactgtatccagcactttgtcaaatgtttaaataaatataaaactagagtaatcttaccactttcatagtaatccccataaagacttaactgtataaaagcaattaatacctcaacaacatatttggtttcttggttttaaagttttatccattggctaagtcaacaaatgcttgctgttctctggtatggaaagcagttaggatataagcagatatatggttttctcatttgtttaactgaaaaccccactgaaactacttctaacattagtttcctattcatataaccataagactataggaatgtaaatcagataacgctttaataatcagctaatcaggagttaatttactataggaatctatgcacttcataatctcttatgtttttccacaaacatattttaaatgtgtaaaatacagtattttatataattaacatgtttattaatagaagcttagttattgaagaaaaccattatgcctacaggatatgtatcttcttagttttttgttgttttttaaatggctaatagcataccctttaccggcgcagcaaattttctgaataggagctgctcagtttaacttatatgtatgtatgtatgtgtgtgtgtgtgtgtgtgtgtgtgtgtgtgtatatatgtgtgtgtgtatatatatatgtatgtacatatacatatatatatacacatataaaatcctcatagcttagctctcacctataagtgagaacgtatgatatttggttttccattcttgagttacttcacttagaataatggcatctagctccaactaagttgttgcaaaggccattatttcattctgttttatggctcagcagtattccatggtgtatatattccacactttctttatctgtccattcattgatgggcattccatatttttgcaattgcaaattgtgctgctatcaacatgcatgtgcatgtgtctttttcatatgacttctttcgctttgggtagatacctagtgtgagattgctggattgaatggcaatactgttttccatagtggttgtactagtttacattcctatcagcagtgtaagtgttcccttttcaccaaatccataccaacatgtacgatttttcaatttttaaattatggccattcttgcaggagtaaggtggtatcacactgtggttttcatttgcatttccctgataattagtgatgtttctgaaggaaaatatattctaagaagacaaacagatgttgaaaagttttaagaaaaatctgataaacactaatttttaaatggttcaatttacagtccaaaagagatctttacaatcaacagtagagggacaagataaatgtacattacacactttgttgcaatgttttacattttctaaaaatcgtgaacatagctcctgttcagagcatagatcaaggtgcttctgcattcacaaacagcattgtgtagaactggagctggcttctgccaccactgcttctggagctcacatctgtggaaacctgcacatttctctggatattctctgaccttgtaactagaactagagccccaccggattagctgcaggttttgagaacaatttagctgccattatagtggagctaagtgttcataattacaaattttgctgccttcaagaaaccagtttacagattgatgacagtagtgattaagagcactttagcttctgcaactttcaaagtacttctatttgtttcaaattcattttctgttacatcctttgctaaaatggctactagcaatatcaccgtgacaactcagtttctactattagcaaagcagtaatttagcagccatttcaaaaccaactgaccaacactagtgagtctcttcttagtcacaagaatcctcaattcactggtaaatatacagtgtagtaattctgaatgaaagtctttaaaaatgtttttggggtatattataagtgtatatatttatatggtatataaaatattttgatgactatgacgtgtaataatcacatcagggtaaatgaagtatccatcatgcctcaaacatacctttgttttacaaataattcaattacactcttttagttactataaaatgtacaattaaataattcttgagtgttgtcaccctgttgtgctatcaaatactagatcttgtttattctttctaactatatgtgtgtacctattaaccattaccccttactcctcatcccccatactacttttaccagccctggctaacagttctcctactctatatcttcatgaggtaaattgtttgaggccaggcgcagtggctcacacctgtaatcccagcactttgggaggccgaggcgggtgttcgagaccagcctggccagcatggtgagaccccatcactactaaaaatacaaaaattatccaggcatggtggcatgagcctgtaatcccagctactcgggaggcagaggtagaggaatcgcttgaccccaggaggtggaggttgcagtgagccgacatagcaccactgcactccagcctgggtgacagagcaagactccatctcaaaaaacaaacaaacaaacaaaaaaactgtcttaatttttacttcccacaaataagtgagaacatgtgaagtttgtttttccgtgcctggcttatttcattcaacctttccatccatgttcttgcaaataataagatctcattctcttttacggttgaatagtacttcattgtgtatatgtaccatattttctttagccacttatctgttgatagacactcggaatgcttccaaatcttggctgttgtgaatagtgctgcagtatacatgagagtgcgggtatctctctgatatactgatttcctttcttttgggtatatacccagaagtaggattgctggatcatacggtaactctatttttagttttgaggaactccaaacgtttctccatggtggcagtacttaaattacattcccactaaccatgtatgagtgttaccttttctctgtatcctcaccagcatttgttattggctatctttagaataaaagccattttaagtggggtgagatgatctctcattgtaattttgatttgcatttctctgaagatcaattatattgatgttgagtatcttttcatatacctatctgctatttgtatgcctttcttagttttgaaacagggtctcactttgtcactcaggttggagtgcagtggcacaatcacagctcactgcagcctcaacctcccaggctcaggtaatttttgcacctaagcttccccaacacctgaaaccacaggcacgtgtcatcatgcctggctaatgtgtcctcttttgagaaatgcctattcagatattttgcccattttaaaaatcagattagatttttttctatggagttctttgagcttcttaaatattctggtaattaatcccttgtcagatagttttcaaatatcttcccccattctgtgtgttgtctcttcacttagttgattgtttcctttgctgtgcagaagctttttaacttgatgtgacctaatttgcccatttttgctttggctgcctgtgcttatgaaatattcaagaaatatttgctgagtccagtatcccagagagttttcccaatgttttgcttcatatttcaggtcttagatttaaatttttttaatttttaatgttttaaaaaatagagacagaatctcactggtttgcccaggctggtattgaactaccgggctcaagcaattcttctatctcggcctaccaaagtgctgggattacagccgtgagccaccgcacccaactgagatttaaatctttaatccattttgatttgatttttgtataaggtgagaaatagaggtctagtttcattcctctgcatatgaatatccagttttcccagcaccacttattgacaagactgtcatttccctatcatatgtgcttggcaccttcactgacaatgagttcactgtagatgtataaactggtttctgggttttctattctgttccattggtttatgtgtctgtttttatgccagtgtcatgctgttctggttactatagctatagagtataatttgaaatcagataatgtgattcctccagttttgtttgttttttgctcaggatagcttcggatattctgagtcttttgtagttaaatataaattttagaattcattttttatttctatttctgtaaagaatgtcattttttttttttttttttgcagacttgtggaggtaccacattggtggtctgagatcagacctgaaggaattctctgggttagcagacagggactcacttcttctcttactttcccacaaatgaagtctctctctctgtgctaggctgcctggggctcagagaggagcaatgcaagcacccctgtggccaccacctctgtgacagcactaggtctgaagctggcacagcactgtggcgggccaaggcccactgtaacacctacctgctgccacctatttcactcaaggcccaggggctctacaattagcaggtagtgaagccagccaggcttctgtccttcccttaagtgcagtaagttctcctggtccctggatggggtcagaggtgctgtctgggagccagggctggagtcataaaccttagacatctacctggtgctctgctctaccatggctgagctggcactgaatccaccaggcaaatccattcccactcttccctcccctttccccaggcagagtagtctgtccccacatatatcgtcaacacagtcccatggggattactgtcaggtcaccactgattctcactcaatgctcaagtgctctcagtcagcctgtggtgaatgctgcctggcctgaaactcactcttcagggcagtgggctcccctctggaccagggtaggtccagatatgccatccaagagccaaggcctgaattggggactccaacagtccacctggtgctcttctccactgtagctgagctggtatctaagctcaagaaaaatcctcttaactcttccctcagcttttctcaagcagagagagtctctcctcacagccaccacagctgggaatgtgctgggccacacctgcagccagcacatctctgagtctcactcgaggcccatggcatgtactacctggtcaccactgatgattcttcagggcccaagggctctttcatcagaaagtgatgaatcctgccattactgagtccctttaaggcatcaagttcccttctggcccaaggtttgtctagatatgctatcctgaagctgggacctgaaatgggggtctcatgactctgaccagtgccctctcctactgtggctgagctagtatccaagttgcaaaacaaagtcctctttcctcccctcaagcagaagaaagaggtctctgtcagacctgtgagctgcactgtctagggttggaggcggggtgggcaagcactccctagctgccccagttgctgtctctgtaggtcacatgcccctaaatacactggcttcaagggcagcacagcagtccttgtggcctagacagactttcaggtttattaaggaccccagagtattttatcccacagtagccagtagcctttcacaactcaagttccaaccagtggcatgaaaaattcctctctggctagggctagtctaaatgcttcctccgtgggtgggcattggatgagcacagccttgttttgctttctgctatgacaaggcagcactgaatttagtgcaaagtcccacagttgctgtgctctccatcccccaagcatgtagcccctcttctcaccacaggtccactgctaggacatgggggaggagtggcatcagcaattcaagactgtcttttctacactattcagtgcttctttcagtgatatgaagttaaaaccaggtactatgaatgcttacctgatttttagttcctatgcaggtgctttttttatttagacagttgctaaatttgctattcctgcggggagcacaattggcagagactgctattcagccatcaggctccacctctgtgaatgcatacattctgaaagacagtcttaactggagtaacaggaaaatgtaaaaaaaaaaaaaaaaaaacccaaaacctcttgccactgcctgtcatgatcttggatcttcatatggtgctcaatgtcatcaagaggtattccttcagatttccctaaatgtcacccacaaagccattctcgctgtctagtggacactgtgacagcctctgctggaaatgcctccctggctcactctgcctaccagctccaaggcccttccctttacaacagtcatgaggccagactggaagaaagaccccatgaagtttctgtttcagcatcatgttggtgccatctgtgagcaaccccatgactcagcaagatttattgcactctcacaggtaactcggggcccccaaagtgctgctgtggttttatgagtgccccaggaacctcctgagtgtggtgagcactgggtgatgctccagcaatatttctcagactgcctgaggggaacactggaacttctaactcatcagcccaatttctaaacacatgcaacactcctactgggatgggacagggacacagggatctgtggctattctgtatctcgaggtttctataaaacagaacttcagataaaagcagggggaacaccagcaaaggcaaattcacaatgtgtaactcagggtgaaactacacagttttcacagtccagaggccttagacctgtcactggccaaataattatttccaaggccacacatgtgctccttacaaagagactggaacttgcacacagctttgaaaaagccataagatatttactgtactattatgttctggtagtacactggtaagataatgccaaaaatattcaccagaaaaatacttttcaatttatgagcagattattaaaacatcaatttaccaagacctaccagcaaacaatgaaaaatatgaactattgttctaaagctggatggaaaaatatgtggtgtttaggcccattttcattatctgcacaacgtaagctttaaaagtatttcttaaagtatttaagtttatgggaccacataaagtactgaaaaatggttacaaagttcacaaaaaccatacaaactcacatttcttcaactgtaatgttcttaaagagcttgcagtagtcctcattccacacagccatatcactccaaaccttggaggcaagaagaatggctcccaagacaatcctcttccagttagttggacaaatgtcgatatcagcataacttacaagtctttctatgtaaatctgcaaaacagagcactggcctttgatttagctcagtttaagtgccaagaattcttatgaatgacagatttcttctggttttgaccagaaagtaagtgcttatgttctacagagatttgcttgatcagaccaaacaagtggccatatcacaattgtaggtcagatacttctgctacctactctgctcatagaaattcacagcccaattttggtcacaagaatgaccgtatatctcagtcaagggcatcatgaagacaggcagtgctgtcaccttcacactcataaaagacagcagacatgcaggcccagtgtggaataaagtcattcaataaatccttaagtgcctacatatgtaatgtctcacacggagctggtaggtagatgggaattttataagtacgtcaagcttgaatatgtaaaacccatgtaatagtgagcaaatgttaaccttcttctcacaaaaactcacccttctgtggcactagctttaaaaactgctgatcaagagagcctcccagcagctgctgtgtagagcagcatggcaggagcaggtctgtggggttgtaaaacattccccatattcagttgctcacttggtaagaaacacatgtgtataaaggatggtccttctcacagcccctatcttgcacatcttcatgatcacttcaaaaaatttattctgtcttacatcacctgcaaattagacaattctgttggttttaaggtggaaacagctgccagtctctgtatccctgggattcctctacacctgccaggcagttggtgagacaatcccctgaattactttacatctatcaaacatctgtcctacaaagaattgagcaaagtgaatagctgagtaaacattaaaggtgaactgtgaggtgttgttacctcagagggtgctctgcagaacagtatgtctgtgagctacttgaactgtttacatcgaaacaaaaggaaaaaactttatataaataagcaagtttatttcttgtctgaagggtatcagattgcagaacactgccagatctgatactgatctgaacactgccaaactcaagtatgttttcaaaaacaaatggctattgaacatgaaattttacagattccactccctttctcccaaactctgcactctcaagtatttcaagagtgaacctccctcccagggttcaactgcgtaggaatcagagacctctgaaacaacatggcaagccctctacttcctgtcccctttcctgctaagctgctgacctgctgacactcatccatgccacgtgcccttctgggtgagtttgagaattctttattcccactgatgccaactcttccctcagtgcagttgatcccatctcacttttgcagcacactgttcccacaatcacctctttctgaagattttcttcctctctaccagaaatttcctccaaattgtgtttcctttgtccccatcccactccccactcctctccaactgtgtcctctcactgatgctcacagcaccataccctcataccagctcctcatcttccatctctccttcagctacactgcctgcccctgctgacatgactctcccaaggctcctcttgccaacaggcacttgtctcttgtgtcttcacgctgacaaactaaagctctgcatacattgccatttgcctaggtgttggggccaaatacctgcatttcagttcccctgctccaatctgtgtgcaatgcctcttacgtctaccttcactggtggtctgcatggtttgatggtgacccacagtctatcactgctcacctgtattaccctagttgcttcttaaccctcttcactgcctccactctgcctcccaactatagcttactgtccccaaagcagccagcataacctcttcatttagagcatggcactcccctgctcaagatctccccaagagcttcccatcaaactggagtaaaaccttaacttcttcctacagcctacaagccaaaaggccctgtgagctatggtactgcctgaagggcctcatctccactctttccctcattcttcactctgactatgctggtcaccttgctgtttgttcctcaaacacacatgaaatgcatttctgtctgtcttggcagtcatcctgctgcctgtaatgtcagcactctttcccgtcgcgccttcagtcaggtcactgttctaatgtcagctctctagagaggctcttccttatctgtctacctaaaatagcccccaatcactctgtatccctttatcctgcttcctcttcctgctgtttcatacacttaagttccatcttcctagaatataagctcataaaagcaagaactgtgttccacctgtcctctcctctacctccgcacttagaagagcggcacagggtcagcatccagtgagtgttcactaatcagtcactgcttggcagcattcagcactgtgactacagcttctcctatcttgaactctttctccttttattatcctcttctgcttttcctcttcccactctagtagacactcttctgggggcttgtcccttaaatgataatagtctttaccaacctatattctgtccattttatctgtttttgagacagggtctcactcagttgctcaggctagagtgtagcctccacctcctgggctcaagtgaacttcctgcctcagcctgccatgtgcctggtgccacaggcatgtaccatcatgtccagctaatttcttaattttttttttttgtagaaatgggtctcactttattgcccagtctggtcttgaactcctacacttgagcaatcctctcaccttggcctcccaaagtgctggcattacaggcatgagataccgtacctggccttactttttgttttcttaagatgcagggtctcggctgggcgcggtggcttacacctgtaatcccagtactttgggaggctgaggcgggcagatcaggaggttaggagatcgagaccatcctggctaacatggtgaaaccccgtctctactaaaaatacaaaaaattagccgggcgttgtggcgggtgcctgtagtcccagctactcgggaggctgaggcaggagaatggcgtaaacctgggaggtggagcttgcagtgagccgagattgtgccactgcacgctccagcctgggcaacagagtgaggctccctctaaaaaaaaaaaaaaaaaaaaatacagggtctcatcatctggcccaggctggacttaaactgctgggctcaagtaattcccccacctcagcctcccaagtagctaggactaaaggcatgaaaccaccatgcccggcttgtccaatttcattctacacactttcttggtatttaaacagctgccgttgctcttcattctgtagctctatgtccaattcatgctctagtcctgtatatccaaatgatgactagactgtgctactctgctctctcaaaggcacaccaagcttagcctatgtacaaaactctcccttttccaatccagctttccctcctgcatcacctatctctacatctggaaacaccactcctgcttccctctagcatgtgctaacagtcccaaatgacttgcagcttctcgagaggactgtatctggtccagtgccctttgagggctttgattcaggtgcacagcaggagccttctcccctagaatctaactggttgctaaacaagtattgacctaagtattttttcattcctggccatgcagttgactttcctctataggtttgttgtggggaggagtaagactatttttaacaatttgagcagaatttattatttaaaatgataggtttacaaaaggaatttgtagggataatgtaaatgtaacgacacagctatggtttggtagaccaactggaaccacattcctgggcaacttcatgagcaagcacaggtgatcagcagggatagataaacacacatcatccaaggaacaaagaattgagggcagcagctgtcaatgacaacatgcatcagaattgcctggggatataccctgggactcagcttagacctacactggcatcccttcctgcccatcagccagatggttttgttactgctccccattccaagctgtccacatgacctggatgtgtgtgcactgtgtgtgcatgtgtttattgatgtgttgggggagaaatcagaaatccctcctgctgcctttaatagcaattgttctgtgatgagaaaagcaactgtgacattttaagccataatgatgattcaactaaaatgtgtgtatttgctttcaaaagtttctcttaaaattctgagataacttcagaaacctactgtattaaaaaacaggaccataccaccctgtttacaagaagaacttctaaagctgctttataaatagaaaatatcttaccaaacttacgattgcaaactcagctgttagcctcatggctttaaacagagtacgaacaaatctgaagatcaatttgtgttcaggatcatacttaaaatattcctccaaaacctcttttcgctgaaagaagaaaggatgcaatgtaagtatccattgaagaaaaaaacctgaggtgctcttaagacagcagtgttcacatttgtgcccatgtgtcacttacgataattttgattggtgagatgtcttttagttttttacaatatgaacagcaggatcctgaaataccataatgatttaatactcatccacattcacttaaaaataatatgagcttaagctcagaaaatgtttatattcttttttaccctttccctcacataattccatccaaatgtaagctactccatccaaatgtaagctttaatgtcttactgactgtatgtcatacttctctgcaataaactttgaaaaaatatagttacctgtaaccatgaggctctaagcctgtgctgataaatacaatagtcactagccacatgtggctattatgtacctaaggaagtacatttttaaatttttacaccatgtaagttgatataaacttaaattcttcttcttttttttttgtttgattttttgagacagattttcactcttgttgcccaggctggagtgcaatgatgtgatcttggtgcactgcaacctccacctcctgggttcaggcgattcttctatctcagcctcccgagtagctgggtttacaggcacatgctaccatgcccggctaatttttatatttttagtagagacagggtttcatcatattggtcaggctggtctcaaactcctgacctccggtgatccacccgcctcagcctcccaaagtgctgcaattacaaaggtgtgagccaccacaaccagcgaacttaaattatttttaaccctcttcataaaaatcatgcttctttgttaaaagtatttacatatacttatactgcttgatactattaacaattatcttttaaaaagatatgttttctgttatttggatagtatatttactcacattagctcactaattaaacatacctgcagatcagttcttattccagcatgttctttttacaacacttttaaaataagatgactagatgccacatgaaatggggaacaagacttaaagaaagatgcctttgactgcgggcacgaaacagatacaaatctatgatgaaaatacagactcaggctgggcgtggtggctcacccctgtaatctcagcattttgggaggccaaggcgggtggatcatgaggtcaggagattgagaccatcctggataatatggtgacaccctgtctctactaaaaatacaaaaaattagctgggtgttgtggcaggcatctgtagtcctagttactcgggaggctgaggcaggagaatggcatgaacccaggaggcagagcttgcagttagccgagattgcgccactgcactcgagcctgggcaacagagtgagactccatctcaaaaaaaaaaaaaaaaaaaaaaacaagaaagaaaatacaaactcaataaaagtgagacttactgggccgggtgcggtggctcacgcctgtaatcccagcactttgggaggccgaggtcaggaattcaaaaccagcctggctaacatggtgaaaccccatctctactaaaaatacaaaattagccggacgtggtggcaggcacctgtaatcctagctacttgggagcctgaggcaggagaatcgcttcaacctgggaagcagaggttccagtgagccaagatggcagcactgcactccagcctggacagcaagattgaaactgcatctcaaaaaaaaaaaaaaaaaaaaaagtgacactgtaagtgggtgtaactgttcatcaaatatgcccaaagatctatgtgcatctctataaaataagaatgtgtattacttcaaaaactgttaatatcttagtataatatctgtttagtaaaataatgcttcctatgtgcctatgtgctttggtgtttacttcaccaaagcaaacagtttttacaaattctccttgatactgacttgcggagggtttcctgacctcttcttcctcagcatagcatgtcctgtactgtgaagtcttttataccataaccagttacaactgcctgtaagtattgaccctccctaacaggcaatggcaataaaccaaacacattttcactcctcgaaccacacactgaaacacaagaacgttttacaaagcagtagtggtgggcaataatctctttagaactttaataaatgtaaatgtgattcagatttgctagcttcctttaatttaaattactaaaaataataaatacatcatgagaatatactacagagaactaaagagaaacatcagtttcatttaaaaatacaaccgggccagcacagtggctcacacctgtaaaatcccagcactttgggaggccaaaacaggcagatcacttgagctcctttaggagttcgagaccagcctgggcaacatgacaaaaccctgtctctaccaaaaacacaaaaaaattatccaggcatgctgacacacatctgtggtcccagctactcaggagcctgaggtgagaggattgcttgagctgagatcatgccaatggactctagccaagtgacagagtgaaactcggtctaaaaaaaaggtacaactatcattctcaaaaataaatgaagctgtcactcattcacaaggaaatgtgtcactcatgtcacaaggaaaataagtatttgtttccagtgatagaatttaagctttcctgaagactttgaaaaacttgttccttctactgtaagcttgacagcttctcaatacttaaggatgttttaaaataaaattggtggttaaattaaaaaagtcctttttgatacaataaaacataaaccaatattttccaaataactaatgcataatattataaatgcaagtatgtggggaaagaaccatttattgtgcaagaaagatcggtgagtactgagaatacatttgctaatatgtaaaatgccactgtaactaatttaagaaactagcacttgtgaagttttgatttagtattaaagaatacccacaactgtcttaaagctttaaaaatacaccttttaccaactacatatttgcatgaggctaggtcatcttattgcttctttaaagcaaattgcaaagaaagagctagagaatccagctgtcttctattaagcgcaacactacagattatcaataatatagatacatgatacactttttactcaacttttcatcatagaaaagttatattttcttttaaaattttatgttaacaatattgttctcaaggaatattttctattgtcacaacctgggtcatgggttactactgacatctagtgggtaaaggccatcagtgttgctgaattttctgtaatgcacaggacagtcttcacaacaaagcattatctagctcataatatcaatagtgttaagactgtgaaatctaaactaaaaatagattttgaaaaaaatctcaagtttatatttctatcagagtaaatatcaatataatcaatataaaatcatactcattgggatacttaatcatttaagaatttaaaaagtctcaaggaccaaagaaaacacaaataatttgcttcgatattttagtaggcacaatacagcttatgatgtctagagctatgatctaacgctgagcttaatatcatgcaaagtaattagccagaataacaagacaggttttaaaaaagctcacctttgcttgatatgataatatagtgccaaggtcacactgtggaaggaaaaaaaatattcataacaataaatgttatcatttgttaggcttgaagacattttttaagaggggggcagaggaaactctcctagcggctctgaaattcaaatcttatagttcagaacagtaccataagggcactttcttattttcatttcttggcttttagcaaaaatatgagaaccaaaatgcaaggcagtatgcttttagaagacatgtttctgttgtgattataatatataaataacaacatatttccctgttatatgctcttctacccacaaaacctttcatcccatgcaatttattttatgcatttatctattttttgacccagagtctctctcactctgtcacccagactgaagtgcagtggcgcgatcttggctcaccaaaacttccacttcccaggtacaagggattctcaagcctcagcctcccaagtagctggaactacaggtttgcaccactatgcccagctaatttttctatttttagtagggacagggtctcgccatgatggccaggttggtctcagactcctggcctcaagtgatccacctgcctcggaactcccaaagtgctgggattacaggcatgagccaccgcacacagcttcatgcagtttacatctatgtgtccatatgtttaagccatacagtagtgttttctttttaagatgttaggccctgcattttagtttagttcactatctcctaccacccatttttaattatttccctaaaaatacataatgaaagtgctttataaaaaaattatttgaaatcacttttgcataattatttaaaaatatattagtaaatatacgcacacaggaaatcaatgataggtgcagtgatcccaaaatatgcagtgctgacaaggcagtataccatgacacagtgtaatatgaatggcaggtaccttcaattagtttaactgaaatatttatgaacagatacacctcttcagatacatgtaactatattcctaagttactcacagatgctgtgtatcacaaaacaagaggttctcttacataagttatgtgcttccatttgctctcagcatctagaatgagactcaaaataactgagggaaggaaaatccctcggttaataataggtctatacaatattagcactttttaaaaagcttataacattagcatttaagatggatatgtctatagtgcttcaagtagttttcacttctaaaatcattttaaaatcacagaatttgaagttacatgctggaaaggaccaatgaccttacatgacatttaatccaacactcattttacagatcagggaaacaaaccttaaaactgacttgcccaaggtcccaccaaataggagcagcttctcatcctaaactcaaattaagcagtgctctcaaactttgctgtacattaaaatcaactgaggagctttaataactgcctcattttcaacatgagactttttagtttaattagttagcattgggtaggacttcaggcattagggttgttgttaaaaattttcctggtgacttcaaagtgcagcaaagtttggagtgattgagttggggtgaaaatcagaatcttctgggatgcttttcttcacaagaagatgcctcacatcgattcctattttcctaaagggcttctcagtgcctagagacagagggaaggttgaggtgggaagatacaaatgtttgcagacatgtattttgaaaaaaaaaaccttgcaaaagtgatcccaatgagttccatctaccccattgacaacagtgtactactaacccataataaacatttttcaaaatcttttcttgaagccaatttgccctattaatttgctcaataaacctttatttcactaatagtgaatataccaaatgataatttctcaaacttgttgatgggaaattaaaacttactttactttcaaaagtagacttctaaaaattagaataatgaggaaaaaagcgtgaaatttgtttgagcaagattaatgtttaaaactacttttaaattgtatgctaacacatcaaaacttttgaattcaaaagaagccagggatacaaaccagagtgattttttctttttttgctcaaggatttagaggcttggctgaatacagacatgtagtgattatgcaataggtcccaaagcgcaggacttgagacagggtttgaatccagttttcactgaaacacaatttcatctctactactgtgataagggagagaggaagtgacattattatgagcgtaaacttgcctctttgttgttgtaattattagttttagaaacggagtttcactctcgttgcccaggctagagtgcaatggtgcgatctcggctcactgcaacctctgcctcctgggttcaagccattctcctgcctcagcctcccaagtagctggaattacaggtgcctgccatcacgcccagctaatttttgtattcttagtagagacagggttttgccgtgttagccaggctggtctcgaactcctgatctcaggtgtttggcctgccttggcctcccgaagtgttgggattacaagcatgagccaccatgcctggccgccatgttttttttaaattatactttaagttctgggatacatgtgcagaacgtgaaggtttgttacatatgtatacatgtgccatgctggtgcgctgcacccatcaacccggtatttctcctaatgctatccttccccttgcctccgattccccacaggccctggtgtttgatattccccttcctgtgtccatgtgctctcattgttcaacacccacttatgagtgagaacatgtggtgtttgattttctgttcccgtgttagtttgctgagaatgatggtttccagcttcatccatgtccctacaaaggacatgaactcatttttcttatggctgcatagtattccattgtgtatatgtggcacattttctttattcagtctatcattgatgggcatttgggttggttccaagtctttgctattgtaaatagtgcagcaaaaaacatacatgtacatgcgtctttatagcagaatgacttaaaatcctttgggtatatatatactcagtaatgagattgctgggtcaaatggtgtttctggttctagatccttgaggaatcaccacactgtctccacaatggttgaactaatttacactcccaccagcagtgtaaaagcatttctatttctccacatcctctccagcatctgttgtttcctgactttttaatgctcaccattcttactggcatgagatggtatctcatcgtggttttgatttgcatttctctaatgatcagtgataatgagctttttttcatatatttgttggccgcataaatgtcttcttttgagaagtgtctgttcatatccttcacccactttttgatgggtttgtttttttcttgtaaatttgtttaagttccttgtagactctggatactaggccttcatcagaagacattaatattctaaattagcactttccaaactgtgttctaaaaatcaatactcataatccaaggaagtgataatgatgtacactggacaaacccaatggagcttgtggtggtgttggttgttgttccttttaaaataaacttcatctcagggtgctctcaaagagcatctttgtggcccatgaggttctcatgcacaatgggagaaaatcaaatgcagatacactgtggtgccagtagagaaaaagctgttccttcttccaagactaatgtccaaagaagtacgcattgatttaggcctgcaatgcactgaaaaactaatatttcacaaaaatcattcaataaagggaacctatccttctcattgagttcagcattgtcttaaggcataaaggcatcaaacaaatagctgcactttttctgggattgcttatttgctgatttttccttccaccatgatgtctaagattaaaagagaaactgatacttaatatttaaaatctggatatcaatatatagttgactccaatttcttaaaatgattgctgaagaggacaaccaaatggctgaaataatttttgaatgaaggagtctatcccttggcattatagttgtactcacgattttagtgtcattgtaagatgaggctggctggctatgctgtcatcaaggaatattgtcgaacatgaactgtattgttgagtaaaatgctcagtagatacctgaaggggaagggaagtataagataaacttatcaaagtatactttttcattggttaaaatgtcaaatttttcaaagcactaggatatttcttacactccatgaatgcctgagtgtggtatcatgagcactctatagaaaacccatcagaggctcttaacttccacagaggatgtttgagatacaggttataaaatgctgcccttaatgtggtgcctatcatcaaaactaacaaggattttatgaattccctttgtaaaaaatgaaaaaagtttaaaataatatttcatttttttatagtgacataaaacagctgaggatttctatttctgttatttatttactacagtaaaatgtaatgtattgaataatattggtataagaccattttactgcaatgaatacaagactaagactaacacatttactaagttactaatcctaaatgtattatttcaggcgatattgtgacaaaacaagtgtttcagattcagaggctcgtgtaccagggctgctaggccaccaacaagtgaggaagacataggtttctctagtcctgttttcttatgtggaggataaaaagagtatcacctaagtattctctcacaccctgaaaacagatgacaacttaaaaaatttaactttcacttcatgtttaaataagactgccatgacatgactcaaatgagaccctcagagaatactttccgttcatttcaaaatttgattaattttattctatacatcatttgacctgcacctaggcattttcctgctctacccctgttctctgtctggaataatgcttttctccttccttgtttcaacaagcttgactccatctaccctcttggatctctttgccagtagcctcagcctcacatgttttgtttttttgtacactaaccgattacaagatactaattctagcagagtattcccctcatgagaaagtacgcctctccataagagtaagggagagccctaactgttcctacctctagctgctcagcataaaattttgaataaatcaaaaagttcaagtgtttgacaaattaattcagttataatttggaaggtaagtcttactacatttaattacagcaaaaacactactaacggtttactgtttataggtattatttaaggtagtcacaaaatagaaacaaatctaacttcagtcagcataaatcacagagtatgaaattttacaatgtttaacaagaaatggaagggtttacttagtggttttaaggttttatgacaaaaactagaaaataatcatacctcatattttagtaaatcaaaaccaaaggctttaccatcaaaggtccagtacctgttggacaccgatgcccaaccactgacttcttccgctgtacctgctgcctctcattttaacccattaaaaacactaaaactgttttccttgtagaggtctttcccctccttgcttagttagattcttaagctggttttttgtttgtttgttttgcagctgttgtaaaggggttgagttcttggtttgattctcagcttggtcgctgttggggtataacagctactgatttgtgtacattaattttatatcctgaaacttttctgaattcatttatcagttctaggagttttactggaggagtctttggggttttcaaggtatacgatcatatcatcagcaaacagcaacagtttgacttcctagttactgatctggatgccctttctttctttctcttgagtgattgctctggctggctaggtcttccagtactatattgaattggagtggtgagagtgggcatccttgccttgttcctgttctcagggggaatgctttcaacttttgccattcaatattatgttggctgtgggtttgaaatggatggcttttattatattgaggtatgtcccttgtatgctaattttgctgagggttttaatcacaaaaggatgctggattttgtcaaatgctttttctgcatctattgagatgatcatgtgatttttgttttgaattctgttcctggggaggagccaagatggccaaaaaggaacagctccagtctacagctcccagcgtgagcgacgcagaagatgggtgatttctgcatttccatctgaggtaccgggttcatctcactagggagtgccagacagtgggcgcaggtcagtgggtgcatgcaccatgcacgagccgaagcagggcgaggcattgcctcacttgggaagtgcaaggggtcagggagttccctttctgagtcaaagaaaggggtgacggacggcacctggaaaatcgggtcactcccacccgaatactgcgcttttccgacaggcttaaaaaacagcgcaccacgatattatatcccgcacctggcttggagggtcctacgcccacggagtctcactgattgctagcacagcggtctgagatcaaactgcaaggcggcagcgaggctgggggaggggcgcccgccattgcccaggcttccttaggtaaacaaagcagccgcgaagctcgaactgggtggagcccaccacagctcaaggaggccggcctgcctctgtaggctccacctctgggggcagggcacaaacaaacaaaaagacagcagtaacctctgcagacttaaatgtccccgtctgacagctttgaagagagcagtggttctcccaccacgcagctggagatctgagaacaggcagactgcctcctcaagtgggtccctgaaccctgacccccgggcagactaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaacaaaagtagataaaaccacaaagatggggaaaaaaacagaagagaaaaactggaaactctaaaaagtagagcgcctctcctcctccaaaggaacgcagttgctcaccagcaacggaacaaagctggatggagaatgactttgacgagctgagagaagaaggcttcacacaatcaaattactctgatctacgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggcaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctcagagattttgtcaccaccaggcctgccctacaagagctcctgaaggaagcactaaacatggaaaggaacaaccggtaccagccactgcaaaatcatgccaaaatgtaacgaccatcgagactaggaagaaactgcatcaactaacgaggaaaataaccagctaacatcataatgacaggatcaaaatcacacataacaatattaactttaaatgtaaattgactaaatgctccaattaaaagacacagactggcaaattggatgaagagtcaagacccatcagtgtgctgtgttcaggaaacccatctcacgtgcagagacacacatacgctcaaaataaaaggatggaggaagatctaccaagccaatggaaaacaaaaaaaggcaggggttgcaatcctagtctctgataaaacagactttaaaccaacaaagatcaaaagagacacagaaggccattacataatggtaaagggatcaattcaacaagaagagctaactatcctaaatatatatgcacccaatacaggagcaccaagattcataaagcaagtcctgaatgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccacctcaaatcaacagaatatacatttttttcagcaccacaccacacctattccaaaattaaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacatatcgaaatgaaggcagaaataaagatgttctttgaaaccaacgagaacaaagacaccacacaccagaatctctggacacattcaaagcagtgtgtagagggaaatttatagcactacatgcccacaagagaaagcaggaaagatccaaaattgacaccctaacatcacaattaaaagaactaggaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagaaaatactacaaacacctctacacaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaacagaggtacaaggaggaactggtaccattccttctgaaactattccaatcaatagcaaaagagggaatcctccctaactccttttatgaggccagcatcatcctgataacaaagccagtcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaatccaacaacgcttcatgctcaaaactctcaataaattaggtattgatgggatgtatttcaaaataataagagctatctatgacaaacccacagccaatatcatactgaatgggcaaaaactggaagcattccctttgaaaactggcacaagacagggatgccctctctcatcactcctattcaacatagtgttggaagttctggccagggcaattaggcaggagaaggaaataaagggtattcaattaggaaaacaggaagccaaattgtccctgtttgcagacaacatgattgtatatctagaaaaccccattgtctcagcccaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccagcaagctaccaatgactttcttcacagaattggaaaaaactactttaaagttcatatggaaccaaaaaagagcccgcatcgccaagtcaatcctaagccaaaagaacaaagccagaggcaccacactacctgacttcaaactatactacaaggctacagtaaccaaaacagcatggtactggtaccaaaacagagatacagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacatgggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccctatcaaaaagtgggcaaatgacatgaacagacacttctcaaaagaagacacttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactggaaataccatttgacccagccatcccattactgggtatatatccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaataaccaaacaccgcatattctcactcataggtgggaattgaacaatgagatcacatggacacagaaaggggaatatcacactctggggactgttgtggggtgggggtaggggggagggatagcattgggagatatacctaatgctagatgacaagttagtgggtgcagcgcaccagcatggcacatgtatacatatgtaacaaacctgcacgttgtgcacatgtaccctaaaacttaaagtataattaaaaaaaaaaaagaattctgtttctgtgatgtatcacatttattgacttgcatatgttaaacaatccctgcatccctggtatgaaacccacttgatcatggtggattatctttttgatatgccactgggaactacaaaacattactgaatgaaattatggatgacacaaacaaatggaaagatattccatgctcatgaatgggtagaatcaatattgtgaaaatgaccatactgccaaaagcaatctacaaattcaatgcaattcctatcaaaataccatcatcatttttcacagaactagaaaaaacaattctaaaatatggtaccaaacaagaccccacatagccaaaacaaaactaagcaaaaacaacaaaactggagccatcacattatctgacttcaaactatacagtgaggccattgtcaccaaaacagcatggtactggtataaaaataggcacatacaccaatggaacagaatagaaaacccagaaataaacccaaatacctacagccagcttatcttcaacaaagccaactaaaacataaagtgaagaaggtaaaccctattcaacaaatggtgccaggataattggcaaagccacgtgcaggagaatgaaactggatcctcaactctcaccttatacaaaaatcaactcaagatggatcaaggacataaatctacaacctgaaaccataaaaattgtagaagataatatcagaaaaatcttctagacattggcttaggcaaagacttcataaccaagaacccaaaagcaaatgcaatgaaaacaagataaacaggtgagacttaactaaagagcttctgcacaggaaaaggaacaatcagcagagtaaacagacaacccacaaaatggaagaaaatcttcaaaatctatacatctgataaaggactaatatacagaatctacaaggaactcaaacaaatgggcaagagaaaaaacaaacaatcccatcaaaaagtgggctaaggagataaatacacaattctcaaaagaagatataccactgggcaacaaacatatgaaaaaatgctcagcatcactaatgatcaggaaaatgaaaatcaaaaccacatgccataccaccttactcctgcaagaatggccataatcaaaaaatcaaaaaataatagatgttggtgtggaaaaggtgaaaacacttctctacaatgctggtaaaaatggaaactagtacaaccactatggaaagcagtgtggagattccttagaaaactaaaagtaggcccaccattcaatccagcaagcccagtactgggtatctacccagaggaaaagaaatcattatacaaaaaagatacttgcacatgtatgttcgcagcagcacaatttgtaattataaaaatatggaatcagcccaaatgcccatcaatcaacaaatggattaagaaataccattcagccataataaggaataaattaatggcattcccagcaacctagatggaattggagactattattccaagtgaagtaactcaggaatggaaaactaaagatcttatgttttcattcatatgggggagctaagctataaggatgcaaatacatagaatgatacaatggactttggggacacaaggaaaagggtgggacgggggtgagggataaaaaactacaaattgggttcactggatactgctcaagtgacaggtacaccaaaatctcacaaatcatcacaaagaatttactcatgtaaccaaataccacctgtttcccccaaaacctatggaaataaaaatatataaataaataaactacggcattcctctcagcaaatataaaataaaatgaaaactcaagtttacgttttcctctctcctttttagcaggacaaattttagaaatgtttttaaataataacttttttctctttctgagactgggtctccctttgttgcctaggctggagtgcagtgtgcaattatagttaactgcagcctcaaactcctgagctcaagcgatcctctgcctcagcctcctgagtaggtaaaactaaaggcacatgctaccaagcctggctaatttgttatttaacttttttttaaaattttattattattatactttaagttttagggtacatgtttttgtagagatgagctcttgctatgttgaccaggctaaaaataaacaaattttaattaacttaaatatttctaacactttgggcattcatgaaaacagctccatctatgttgtgaggtattgggataatatggcagtgaaagtttgaataaaaatattaaataaggccttaggagaaaagtataatatgcttattatagatacatcactaaaaaaattgtctgggttaataccattaattatattgaaattaaactttgattcacatgtaaatataggtcccaaatttggattaagtataatagattggccacagatttatttcctctgcctctggaagtctcgttagtcatacataaaatacaggttacacacaggatcaagagagaacgttgacagagatgatttttaataaatgctgggtcataaaaagtagataaaggagtggtaaataacacagaagcacaactttggtccctacagaaagcgactggaagagaagcaagccagtttgtcttgtagaactaaaggcaggctgtgaatttacaggcaaatggaactttggaaagtagggtaaaacataaaacaaaagccagcaaggtcagaaaatctgtggttagaactccaaggccacctgtcgacccatctgataagaaacttagatgtgtgttctctggatataccaaacctgagaatttctaggttcagaaataccacggcgtaaaactgagatataaagaaaactgtacaccaaaaatagaactccaacttgcttccctaattctgcttttggaaagcaagtagccattcttttacttcccaggaagaaaattgggagatcctttctcagaagaaactgaactggctcgaataaagatccccagataatacactgaagtcccacaaatgaaaagctagtttggcttccaaaacctcacactgagtgccaccagttaacagaagtccagcttccaaataaagccagggaccaccacacattggagggaagcctccaacaagagacatcaaaacaacagaaaaaagggattcatgggaccagtcaaaatcaggagcaaaacttacaaaaaaaatctgaaaacactctgaaaaagatataaaattcaatagaaatgttagagtaaaaagtcacagaaactgaaaaatcgaaggggaaaaattaaaaaccactgcaggtatactggtctaagcagctgagtgtctgaataacaagactatcagaaaaaaaagaacagagaaaataaaaaaattctcaagaagagatagtcttcagacttagtagcctcaataaaatgaaaagattcccaccaagctgttatgaaatttcagaatctcagtgagaaagaagctgctaaaaagcttccacagagacataaaacctggttacaaataatgtatctcacaatggcaacagagtcaagaacaacactgtaatgattgcacaattgcaaaatatcttcagaaccataaagtttagattcaacctagaagtttgctctgtatcaaaaagaagggattttaagactggccagatccctaaacatctctgcccaggaaaatgtgctcaagtacaactagtgaggataacaggacagaaggaaacagaatctaggactcaggtgatcccacacaagatggcagttatgtgagatcccaaaagacttcaaggagctagcacagaaaagcagacattgagcatatctagggaaagccactctgtattgaactaggatgacaaaatgccaaagaaagttaccccccacccctggcaaaaaaaaaaaaaaaaaggaatatatgtgttttagcagatggaaagtatatttgaaaggcatgtgataaatgcagcaacacttggggggaaaacagctgttagaaaacaggcaaatgaatatagtcagaaaattagcttcaggctaaaaaaaaaaaaatggatgtgaaagcaaacagaccagccaggggctacttactgcatttggctgggtaaagtaacataggctagggaaaaagagatgatccagaaaaagtacagaaatgctcagatttcagaactgtttcagagaaagaatgaaggacatataatgcagaggcacagtgaaaacatcatatgacttagcagtgaatagaatttgcatagtgataatcatgtaaatattagtgatttaattaaaaagtgtgctacaattggaagaaacagagggagaaaaataaggtcatggtgtagtgaggaaggtatgctttcacccgctatgacaaagtcaatagacagtgctgatagctattctatttttgttatttgttactctgtatttgttactctgtatttgttattttgttatttgttaattcttagctattctatttttgttatttgattaagaatatgattaaatatttaaggcagatctttgtaccacaaccagagtattgaaatttaacttaaatgtcagaaattcttaaaatttctaagctgaagacttctctgaataaattttatacttaggaaaatacaaaaagaggtccgtgctatcaccacagggtccccactataatttcaaggaatcaagagagacatatttttatatcaaactatcaatttcttaaccttttgactgtttacgtacatgctttgcatagttgctttttctttttttcttgtactaagaatgaaaaagaaaatggtcacttctgataaaaataccataaaataagagtagtagttaatgtcttactaattactcctaaatgaggaaaaattccatttaaaaaaattactttcaacaatttatatttaaattatctggcatgataaatctcatagagtaaaatctaataacttagttttactttttgacctagtttactttttgtttctgttacacacaaatgaaagaatccttgtgcacaaaagaaaagggcaaaaaaaaaatggggacagatgaaaaagttagctaataaaaaatttaactgttgcatatatgagccatgagtattttctcattctgcatttacacatagcttactttatttgccagaatctgagagttaacagctctaagaactactttctggccaggcacctatctctggatgcaccagaatccctgtaagcatctcgaaccacacttagtgatcatctactaatatgtcactaaaaacaaaacaactggaaagtaacttatcttaaatttaaattttaaaatgactatacaaacctgattggacatggtgtccgcagcacaaaaaatcatttttttctaaaaaaaaaaaaggccagcataataaaagctccaagaggacttgggccatgctttgtttcctacaccgcctccacctttgatgctggaagggccttgcaggcaaacattcctaccactgaagagtgagggacatgaaatagcttttgtttttacctcttctatgctctctatgtgtgagaagcccatagctctggaaggaactgggaaaaacaactctgacatggcttggatattttcccccctccaaatctcatgttaaaatatgacccttaatgttggagaaagggcatagtgggaggtgtttaggtaatggtggtggattccttatgaatggcttggtgccatccccatggtaagaagcaaattctcattctggtagtttaagagagaaagggaagtaaagctctcctcagcaaatgtaaaagaacagaaattataacaaactatctctcagaccacagtgcaatcaaaccagaacttaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactacatgcccacaagagaaagcaggaaagatccaaaattgacaccctaacatcacaattaaaagaactaggaaagcaagagcaaacacattcaaaagctagcagaaggcaagaaataactaaaatcagagcagaactgaaggaaatagagacataaaaaacccttcaaaaaattaatgaatccaggaactggttttttgaaaggatcaacaaaattgatagaccactagcaagactaataaagaaaaaaagagagaagaatcaaatatatgcaataaaaaatgataaaggggatatgaccaccgatcccacagaaatacaaactaccatcaaagaatactacaaacacctctacgcaaataatctagaaaatctagaagaaatggataaattcctagacacatacactttcccaagactaaaccaggaagaagttgaatctctgaatagaccaataacaggagctgaaattgtggcaataatcaatagcttaccaaccaaaaagagtccaggaccagatggattcacagccgaattctaacagaggtacaaggaagaactggtaccattccttctgaaactattccaatcaatagcaaaagagggaatcctccctaactccttttatgaggccagcatcatcctgataacaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaatccaacaacgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagacgacatgattgtatatctagaaaaccccattgtctcagcccaaaatctccttaagctgataagcaacttcagcaaagtctcaggatacaaaaccaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcagtgaaataaaacaggatacaaatggaagaacattccatgctcacgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaaccctaagccaaaagaacaaagctggaggcatcacactacctgacttcaaactatactgcaaggctacagtaaacaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatacgtagaaagctgaaactggatcccttccttacaccttatacaaaaatcaattcaagatggattaaagacttaaacgttagacttaaaaccataaaaaccctagaagaaaacctaggcattatcattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctgcaaaatgggagaaaattttcacaacctactcatctgacaaagggctaatatccagaatctacacagaactcaaacaaatttacaagaaaaaaacaaccccatcaaaaagtgggtgaaggatatgaatagacacttatcaaaagaagtgccaaaagacacatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagtcagtgtggtgattcctcagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaatgatagactgaattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatattctcactcataggtgggaattgaacaatgagaacacatggacacaggaaggggaacatcacactctggggactgttgtggggtggggggaggggggagggatagcattaggagatatacctaatgctagatgacgagttagtgggtgcagcgcaccagcatggcacatgtatacatatgtaactaacttgcacattgtgcacatgtaccctaaaacttaaagtataataataataaataaaaaattaaaaaaaaaaagagagtgtgacaccttccctctacctgcctctccctcccttctcactgtgtggaaccacctgcttcccctttgccttccatcatgattgtaagcttgctgaggctctcaccagaagcagatgctgaagccatgcttgtacagcctgaagatctatgagccaattaaacctctttttgttataaattacccagccttaggtacctctttatagtaacacaaaaatgaacacaaattctaaccagaaataacttactcaagacaggcaaagtctactcaaaactacaaaaaaaaagttataaactcccatatttactgcactgcattacttcccatattaatatagatcctcacttgtattcttgttgcttaaatcaactggaaaacttggctgtgtatggctttttagcaaacaaacaaggatttaacataacattaaggaaaataagcagaagtagggcatgtttaaatttacatcagatgacaaggttaatgacttaaaagttccgagaagtataaacttggatgtgataaatgcatgtgatcagaggactgtgcaagaggaggccaaaatcacagattcaatctctgttgatgaacaacagtttttttttttttatttgtttaaatggaaaccaagctgaagcctaagttctatctttaaaatgcacccttaggagcaaggaaaaaggggcaaagaattataaataaagataaatctatgactcctccatcacatgacaaattgtgttgataaaaagatggcaaaatgtataaataaaaaatttacatgatttcactaacacagtaacaactaaaaaaagtatatcacatattaaaataagacaagcgaatatgtgaaaagttcaaaaaattaaaccaatatgagtttttctaaatactttctataatacatctgatcaaacaacaagagttttcgatctttttcttggcagaaaaaacaatgttgtctcaccatctgtttgagattttctcaggaatattgtgcttgcctttggatggtcagaagggttgggctccaaaggtatatctatagagggagagaagaaaaaaagatgtgatcatttataaaaatttatcaactcatttatttgactgctgcatttaggctatttcactacctctacttttatccttatccgttgaaatgaatgtatagacataagatagagccaggcaagatggcacaggcctgtagtcccagctcctcaggaggcggagatgggaaaatcacttgagcccaggtcaggaatttgaggccagcatgagtaacatggtgagaacctccttcatttaaaaaaaaaaaaaaaaaggtaaatttgcctttaagttgtgtaaaatcaactgcatagaataaaacaagatggcaatatgttttaaaagacaggtctattttataggcaaaatataagatgtaatctggagtttttaaaattttaaaaaagtaaattcagcatatctatctcttccatgtcattctgaggacacagaaccttagttctgttgagtagctgccttccatagttacatgagatctctaagtcctcatttcttcattagcaaaatgtagggagaacacatataggcctttatttgtattgcaaagagccaaatgagacatacataaactgtgctgtaatcctaaagaatgacaataaagagccttttttgggctctcatccaacactacccgtctattaactggtgtgtaaaatcactcagaggctttccttacaccaccaagtggagtatgtttacacaagtacttacatgctttgtgtataaaagtataatgaattaattcacatatttgtttaaattctttaatatcttgaaaagcgagtatagtactccaagttacaaagtcacacatcatgagtcttaattattctacctctgaaaaaaataaaagcccaaccaaagttgttatttttttgttttttttttgtttttcactttaagttctgggatacatgtgcagaacatgcaggtttgttacataagtatacatgtcccatggtggtttgctgcaactattaacccataatcaaggttttaagcctcacatgcatgaggcatttgtcctaatgctctccctccctttgccccccacccccgatgggccccagtgtgtgatgttcctttccttgtgtccatgtgttctcattgttctttttgtttaggattgtcttggctacacgaagcccaatcaaagtttaaatagaagagctataagacatttcctctacagtaataaatctctggcatttaaatgaaaccaaagagccagtggatttaatatctttatgatacaatgttttctatttgtaaaaatttagtttttattcaagaaccatattgttactcagaattctttttacttagattcacctctttgcaaaagtttagaggcaaaccaactaagtgttttctcttttctaccccctcccatcccccgcctctcccagcagtgtagagactgaaaaactcttaagtttcttatctttgaacaagatgttattgtcaggagggggaaggacaaaggggaagccatggcaacaaacactcttacacaggcaaggtctgacattttaaccttcaatctttatattacacattcaaagtctacgtttacgttttatgtcttttgaaagttttgaccacgaatcatccccacctctcttttagaacgaggaggtaaataatgtctgttaagtcgccagaataaatctgcagacacattttgtgttaaagtaagaattttaaagtaatcagagcctcataggtacactcctttgggggaacccccccacacccatttttctgcagccctagccatgacatttcacacctttcccaattattttaagcaccctccattttctttccttctgtgttcaacttagttagaagaaactaagcagcttctatccaggtgacttaaagcaacccatatagtctctcctatggcaacctgcattctgattttaaataagaaatccccaaatatttcagtatgaattgtcctgagatttggctactttaacaaaggaaacaattaggcacttacctggttccttcacttaggtaccacctggataggtataaagagaatgagatgggtactggaaagttgggatatttgagtttttattgagaaaagggagagaatattccaaagaagcctcaacaaagtcccacaggatactaaatagagctacagacaagaacagccataaataaatggtcccatgccagaaggggagaatgagatgagggagcaagaactgggagttttggagggaaggaaaaaataaactaactggagtctttggggaaagactaaggggtgggaacgcaaggcaagccaggttttgttcctggacaggcctaggatagctggctacaggcagaaaggagcctgaggtgggggatgcctcccagaggaccctggggacagcagcagccagaagtatgccgagggcagaaggcacctgtcacctccttaccttcaggcatctcccgttcacagatgtggtgcatgtggaggccctcaccagctacaaaagtcacctcaccaggctctacagcagcagccacaggcactcctgctatcaggtccccagctgctgcctcatagatctcagactcacagtgacacaccaatccctggtgctggtgcaacccagggctggccctggggcacacacaacaggtcagtatgtttcccatggggtgcctctactcctgtcaccatctgtgcctttgctcacagcttgggccacacactcccgctgccctaggctgaggctatgctgcacttgcagagatggtcttgcctgctgctcgcctgcccacttcacagcccaggcatggccccagctggggctgcgggccaaggcccgtgccctgctgactcccctgagttgacttgtctgggagggtgaagaccagccggcttatttaataggttgtgaacccaacaagcgctgagacacacaacaactgcctgaagagagaacagatggagctcctcctccttctgcagtcacctacagactgaagcccactggcccaggtgggagcccaggcttgtggctcacaatgccccgccccacacttcacagtgccctccccgacacctcacagtgccccaccctggctgccacccctcccccacagctcaaaatgtccctgcctgggctgccccaccctgtgacttatgctgctgctgctctcctggcccctcatgcagtgccagtgggactaagattttcattcatcaccagcttcctgagctttttagtcctaagaaaagcataaggtgtttccttacttgaagccatcttcctctatgagttctatacaaaccctcagttagtagagtgggtcccattagcaaccaagttgaacaacttttatttgctgacttaatgtagacacacctgaattgttgactgcttttgtaactaaatattcctctcctgtcttccaatgagtggtagtttttgtctgcaacttgaccatagcggtccctggggccctagctctactctcaataaagaattatggctgtgtgtcttgaatcacaccttaggacccatcctgcctccacctccttctccataaaatagaaacctaacttgtccctccaagttctgaaatgctgaaacttaccaactcccttttctaccctctgtttcttccttccatggcaaggactttcagattttctctcttttactaaaaagcattaagcatgattttgtcatacaaaatagagagctgtaaagtggggtaccacagtcctaattcaataaagatgaatattcaatatctggcaatcagtatgtgcctgacagtgttctaactatgctatgctcatttaaccctcagaacaatctcattttacaggttttacagaagacattgaaatggagaggtaagttatctccccaaggtcacacgactgctcaggctggggccatgatttgatcccaggtagtatgaattctccaattactcaagtgtgattatcagaaagtgtattggtccattttcaccctgctataaagaaatacctaaggttgagtaatttataaaggaaagaggcttcattgactcttgttctacatggctggggaggcctcaggaaacttacgatcacagtggaaaaggaagcaggcacttcttacatggtggcaggccagagagcgtgagcgtgtgaaggagcaactgtcaaacacgtataaaatcatcagatctcgtgagaactcactcactattatgagaacagcgtggggaaaactgtccccatgatccagtcatctcccactgggtccctccctcaacacgtggggattatgggattacaattcaagatgagatttgggtggggacatgcccaaaccatatcagaaagtaaaggtagaagtcaagcttggagggaaagtgacatagtagattagtacatttttaaaagaaaaacctttttttgatgtggattttaaaatgcctccccttcattcaacattgattaagtcccttctacatgccaggcactgtatgtgtgaaacagtcctttcacatcttttctttttttttagatggagtcttgctctgtcacccaggctggagtgcagtggcgcgatctaggctcactgcaagctccgcctcccaggttcacgccattctcctttctcagcctcctgagtagctgggactacaggtgcctgccaccacactgggctattttttctatttttagtagagacgcgatttcaccgtattagccaggatggtctcgatctcctaaccttgtgatccgcctgcctcagcctcccaaagtgctgggattacaggcatgagccaccgcgccagaccaaaacagtcctaactcttaatgctcataggcagatacaaaaacaaaggcttaaggagttcagttgtctgagaccacactgctggacagggtataaacctgggatacagactcacctctatttgaccccaaatttgatgctgggatggttttaattttattctgaaaatttgagtcactgaaccatacaaaggtgaagagtctctgtcagatgtgggtatagtggtctgtataataagaaaggactgaaggaagtaacaagaccaattaagagactttatctaaaagaagaataatgataaaggcagtggcagtgacaaaagtcgaggaaaaattttccgatcatttcagagatggaataggaagtgtgtggtcaagagatgtgaaagaagaggggaagtagagggaaaacagagctgctcaggctctgctggggaagactgggtatgtagcagtgccttcctcctggcagagaatgtaggaagtgaaataggtaaggaggaaaagatagttttttattctcagtgtcacataaaatggaattctatggtcaaaagttgaatataaatctctgtaggctaagttcatttgtgacatcccaacatatgttttcaaaaataacacacatactaaatcaaaccattaagagtaactggggaaattttctaaaatttgcatgctaataatatcaccatttttcatttattactttcatggagcaattctgaatctatggttatagcaaatgaggcaccttgtataaaataaagctactacatgaaacaaaacatttaaaattctattgtcctcagagaatagagaatgcaactgaagccatggtcatggaagtgattaccttgagaagttgtgtacagtaagaagaattgggaggaaaaaaaacctggagaatagggtgatttccacggcattaagtgaagcttgccaaagtgagcactgggagtcaacagacctgcatataaatcaggaatggctgcctctgtaagtcattagaaaggagatgatgtctgcttttcatttctataacagcagcacctaacacagtgcctggtcaataggtactcaacatgtattatctcaatgcgcagagtcaaatgttgccaggagggcaggaaagctacaaattggctatgataacttagtgattgggcttgtgtgtgtgtgagtgagctggatgtcaggtaatgggtaaagtattgaactggaggtgagaaaacaatgacacaaactgagggcttctctttccaagtatttggctgagaagagagatgtaggtagtagttaaagggtaaatatggtaaagaaagtcttttattccaagattcaacaaaaaggatgagtatacttctatgttaaagggaaagagtcaacagagaaaatacatttttgagtttagaagagaaggaagaacaaatgcagaagggccctcaaaaggcacaagtgcatgcaatctggatcagggcagattagctttggacttctacaaaagcaagatgggagaaaggaccatgtcattccagagatatttctggtagaggaaaggtttaggaagagatcttttgatgacctctattttaatagacttttcaaaaaactactgtgggaaaaaggatgctatgtatagaaaagtctacaattcttgatacatctaacaacaacaacaaaaaagcttgatacactaaacaaaacccaaataatgtcttccctaaaagtggataactggaaaagcaatttgagcataaaccaaggagttcaattaccagtaagtatatcaaaaaagtgaaacatgggtttaatttttcccacaaagagttaaaagaagtaacaacaactttcggggaagaggaaaaaagaagaagaaaattatatgaaattccaaaatgtgtgaatatttacaaactctaacataagttcactacaaaaaggactagaagaatcatcatcataggaagcaatgggtaatttcaaaaatcagggaagaagggatgattcatatgtaatttaattttcttgaaaatatttaagttcgaggacaaaaataggtgatacattgaaatgtgggaagccacagtggcaaaaaaaagaattcaagaaagttcagtttcagtaaccaatatctagtaaaaccctcaggacctagtggctacaatctgcgttaatagcatctgaagacctagaaatatcattagataccattttggataatttttgttgacttgagatgatgtctatttaaagttacaaaatagtgcctgcacttaacaacagacacactcaaaaacaggtatccatgactttacttttactttttatttttttgagacaatctcactctgtcccctaggctggagtgcagtggcacaatcttggctcactgcaacctctgcctcctgggttcaagtgattctcctgccctcagcctcctgagtagctgagattacaggcacacatcaccatgtccagctaatctttgtatttttagtagagacggggtttcaccatgttggtcaggctggtcttgagctcctgacctcgtgatctgcccacctcgacctcccaaagtgctgggatttcaggcgcgagccactgcacccggcccacagatatccatgactttaaaaaggaagaattttaaactctctaaacaggaaaatattgggaagcattgttatgaaaatagattttaaaacattttggttgaagacaatattgaagtacattaagaaaaatcctatcctaccatgacattggcaagtctgagagagcaaagagaaataagttggagtactgtgatttgaattaatcaggagcttgattctgtgaaatgagctgagaccttgtttctttatggctccaaagtaaactaattcatccattcattcaatacctatttagtacctgagcccttagcaaacatgccgcacactgtatgtaagttctggggctattgcttggaccaacataaacaaggttcttattcttgtaaaacttatcttccagtaagggagttaacagaccatgttgcctgctttacctaggatggctactgatctccagctattggatcttcattccagacaacagggtagagggagtaaagaagaaggaaggttttttagaaggtactcatagcacagtgcttacaaattattggcttaaaacttagtcacaagaccacacctagctgcaggggaggttcaaaagacataatcatatagctagggtaatgaatacagaagaaacaattggatatggaaaggaaactagcatgccattccacaatctctaaagaaagattagggaagttttggcttaaagcaagaataatcacaataaaattttacaatcctttgcaagcatatatgaaaacatacaaaaaagtttgtaatgatcttttcttaagctgagaggacagaaaaaatgagaaaaattaaattattaagtgaaactttggtttagaggtaagaaacatttgatgacagtcaagagatcagggttgtacagtatattatgtgaatgttgtgactcactggtttcatcttggatatcataacttgacattttgtaaaagtcgtttttcatgagaatttttccaggtgccctataaagtcctgtcccatcaaaagtgaataataatcttccatattcatgagatatcttaatggcatctcctacagtcttccattgtttagtttaggtaaacctgggaatcacttttgggtattgtctcatccaacttctgttacccatccgcagcataagtcatgaaggtcttggatattttgtgctctagcaattaattcatcatgaatcctggagttattttctattccaatcatttgtcctactttgcttcccttaagcataatgaatttaccaccattaacttctaaaccatatggaatttgtacatgtgatttgactttgtgagcaaaaattctatggatgtcttgaaatttgtgcctagtataaaacttattttcagtagagattatatttctgcactcaggcagctatgtaactttcactgttattgctggtcgggctttccagacatgatgataacctcctaggttctctggaagagggacatattcttcaggatgacattataatattttgttaggtaaaatcttttatctatctaaattgatagttcctaatgtcttgagtaacaagactagtactttttatttttgttagctctgtgagttaatgtgaccaatgcctgaggttgagtaatcaggccagtatcagactggtctttgccagaactttttgcctaatacgtttctctattgttttctacaggtcacaggatgttaacacgggttctagaatgcaatttttaaaaatgttttgtgaatgactagcaacatggtaatttaattttcaaatataatttacaagtgaaatgtgtaggactccaacaaggcacaatgacctagatcctgagtatgattccatcggaagaagcaaatactgagttgaacaagctcactcatgtctgcttacaccagtcacttttgaatgctcaatggcaggcagggggaatgacctgtgtttggcagatgtccactcagtatgaccctggattggacatatagttaccttgggtcaggccagccatgtgttgttggactattccttggagatacactcttagtgactgtcaaagttcctgagtcattaggtgcctgcagactatgcccactgatatttgcattaggtgcaggctgcctagctgtgctgacactgagtgaagctgtgaggtttcacaatgacatggcagccaattacatatgctcagatgtaccatgtatcaagagttattcacataatcaattaggcaatatcattctacacacaggcagtaataaagggagtaaaaaaccacaacaatgactcgggagaccaatgtgcctccagaagagtccagtgggtccagaagccctttagatactggtcagaggttccttttgggcagagatcacagcagcagccaccaggtatggagaagtccttagagttctcatggacaaagcttctgaaggcatcttggacaagaccttatctttgctggcttcatgatcctatgcagatgggtccattctcattttctcagccacctttcacttcctatcagttcgtttcaggtctctcatgatcccaggcagcagtagttgttatcgtctcagtccaatcatatatgtttatctctttggggatgaggggacaacttcattgtggacttaattctactggagatgagtgaccccattttaagacatcaggatcacaaattattatcgcatgtcatcagggcagagaatagctacaacctggagctgaaagcagataactccatttattctagaaacattctgtcttgattatggtgccagttactgtgagggacttccttttctccacctattttttacaaggtttgagtctgaactgctaatattctactgatttatggatgaagggactgactgcaccattccagcctgtcacagcacttgcaccaatacttccactttaagagttttccaccttgtccagaactacagtccattaatcccctcattttctctcttaagagaataaacaacacatctcatgtacatacccacacccctcttctcccaaataccaaatacacaaaaatccaatctctctcctacctaagcaattttagatagtcactttctcttaattactttaagctccctgactcaatgcttgtcttttctctggcaaaatctcatccctggatgagcaccactttgtgttggctcaatgacaccactcagctgaaccagaaaaatatcaaaaagtggtcagaggtgtcatcataaattcaaattacttacataacaaattggccctaaatatttccaaaaatcaataaaagttttgtttctccaatgacatcatttcttcagaaacccaacatgtataaccaatcttttctatgttcctctaacttttattctacttctttcacctgaatatcttgccatatcattcaaggagaaaatatatcccattaggcaagagccgatcatcttcccatcacctaagaaactaatatgcacaggatgcaaccacctcatctttctctgactcatcatatcagaaaaagtacctttccttttctcacaaggcaaatctgagataaaaggtttagatggcctataattctagcacctggggagaccaatgcaggcagactacttcagcccacgattttgaaacaagcctaagcaccttagggaaacccatctctaaaacaaatacaaacaaataagtagctgagcatggtcgtgtggtggcacatgcctgtagtcccagccactcagggtggggagcactgaggtgggaggatcacctgagcctggaaggttgaggctgtagtgagccgtgatcacaccaccacactccaggtggggcaacagatatttttaaaaggatcttctctgttaaaaatgatcaaataaacagatggctatgaggctgaggtggctccagtatgctcagttcctccttcaacaaaccaaaacttgactcaattaaataataaaaggaaacttaagcttaaccaatcaagccaccaactatcatctaaccagagactttccaccgtaatgttccaaatgaggccactgctgcactttccccaatcaagtattttctttttctttcatattcaccatataaaagccttcccccaccctccctaagcctctctgttggagctctgggatgtttgcagtctcaggctgcttggtttatacatttccgaatgctcaaatatacttcctaatgtttcaaagagcctaattgtatcttttaacagctctcatggttatgtcattgtttctggattttcaagttctacctccttcatgggactgattctcagtatgtgaacacgttctcttctaccattctaaagactctcctaatatgggcagtttcttacaaaactataacacactcttactatgtgatccagcagttgcactccctaggtctttatccaaatgaccagaaagcttatgtctacacgaaaacctgcacacagatgtttatagcagctattaaaatagctgccaaaagttaggaggaaccaagatgtccttaagtagcttaatgataaatacaaatgtgatatatttagaaaatgaagtattaatcacctctgaaaagaaatgagctattactaactgtgtattacacactaaatgcatattactaattgaaagaagccaatctggaaagttatctacgctatgattccaagtatataacattcagaaaaatgcaaaactatggagaatgaaaagattggtggtttccaatggttaggaaaagaaaggataaatagagcacaagattattacagtaatgaaaatacactgcaggatatcataacagctataatgatacattcattatacatttcattctcattatacatttctccaaacccttagaatgtgtgccaccaagagtattgctctgggtgatgatgatgtgtcaatgtaagttcactgactataataaatattctactctggtgtaggaggtcattggtggagcgacccaagagtgtacaggaatcgagggcatatgggaactctggactctgcactccattttgctgtacactcaaatctactctaaaataataatgtatctttaaaaatctattactatcacatagcccttttcaagtctccaactggtctgagccagttctattaaatctcagaaaacactggttaataagctagttctgacccaactggcaagaagaggcagaaaagacccaggccaggggagcatattgcacatgcatgcaccaggaaactggaggaagcttggaggctctttagcctagtcctgagcctgctgaaactgcagttacaggcacaggtgcctggggcaccaatctgaatctgccaacatccaaggccacatgaacacaaatgcgcagagtctcctccgcaattggtagctaaggatgttaggccatgattggactaccatgggagatgatctggggacaatagattctgtagacttttgttgtctcttccctgccccaagcatttcactctttactcttgccacaggcagcagggaagctccctatgtacatcatccccacagcctatagctttgtcacaccctcagtctcataccctcctatggcacagtcagtcaggacatccaaccctcaaactcaagggtgcaaacacggccaagataatggggtgagcagaaccctcacctttgatctgcagacaaatgccccctaccttctgggcctctaccagcaacgggaggctctggaaatttccagacacacaccagtgttctgaactgcaggctgctgccccatcctatggcagagtagacattttctccaccagattgccctgttatccagttgaatgaaatgtctttttaacatagaaacagggcacagaaactagtgttctttggccctgaaccccatcacactgtctgcaggtatacacccatccttagcaaataccacagatttgaggactcagtccctggagtgtggtcattggctctgctttcagaaaacatcaaggtacttttggcaactctgcagatttcatgaagaaaagcaaaaacataaacaaaaccaagtgatgaacacacacacacacacacacacacacacacacacacacacacacatacacacacacacacacaccccaaagtgacaggatgtccctccaggacatttgcagagaggggagcagaaaacatcccaggggcctttcacagctacttccttgagcccattttcagacagtgctgtctagacctgtctcagcccaagcaccgccaccctgatatgcaggagctggcttccctacctgaaattcaacatcaagaaatgatctcttggccaggcatggtggctcatgcctataatcccagcactttgggaggctgaggcaggtggacagcctgaggtcaggagttcgagaccagcctgactgacatggtgaaaccttgtctctactaaaaattaaaaaagtagctgggcgtggggttgtgcccctgtaatcccagctacttgggaggctgaggcaggagaatcgcttgaaactgggaggcagaggttgcagtgagccgagaccgggccattgctctctagcctaggtaacaagagcaaaattccttctcaaaaaaataaaaaagaaaagaaaccatctcttctacttaacattaacaggaatgtcctcaagcagtgtcctcattggcaggggtggagtgggggagtttcttaaaaagtgaggtctctgcccaccacctagagaacctggaaatgtccatcaatgccacaaagtccaaatcaatggatagtgctccaatgtatggcagattagaccatctctccattagatctgggtttctattccattaaatgaaatggcttttctattacagggtcaggataagggatcaaaagggtcttacaactgaactccagtgtacagtctgcacagacactaggcttgtgcaaatatgccacggcgaggccccaggacccttgagccagctgaatgcactgagtttcaggaaacaatgagatacattcagcaaaaaagtgggcttcatgctgaaagaaatcaagccaagaacacacacatcactctgacacacacacacaaagacacacacacacatgcaaacacatatgcagacaccctagtggccaataggtcctttcaccaggaacctgcagacaggagagcagaaagcctcccagggttccatcactgcactttctggagccccttatcagacggccagccccaggacagcactgttttatcctggtccagcccaaactgcaatctccctctgatgtgggagctggcctcctcaccagaacctctctgtcagacaaatttctttttaaaatggtgagagagaaccttcagacagtgttctgatcagggtgggtggagaggggggcttcctaggaagtcaggcagggcagggctgaagccctctgggttagctgtgggcttttgatataaaggcagataagactggacaggtggggggttagtgaggggatggactggggtgtgctgaagaactccagttgggagtgttctgttgctataactgagttcctgaacctaggtaactcataaagaacagaaatttattctctcacagttctgcaggctgggaagtctgaaatcaagaggcctctggagagggcattcctactacatcctcacatggaggcaggtgaaagggagagaggatggatgtgatgtgctcacatgacagaagagtgacaaaaagtaaactgattccttcaagctctttttatacttatataagatgtaactattttgtatgtatataaaaagtaacatccccctcatctactacagggtagtagataccacccacatatgggaaatgcagaatagataaataatttattctctcctttatcagttttccaaataacatgtagcttttttacctaaacacctccattaggctgcagctcccaacactactgtcttagggattagagttctgagagatacattttgagggatacattaagaccatagcaattgtaaaaccaaagagtatcccagccaggtctcaatcaatgtagtagtttattttgccaaggttaagaacatgcccagaagaaataaatacagaatcacagacacagtctgtggtctctgattttctccaaagatgattttgagggcttcaatatttaaaaaggaaaagtgacctagagaggaaataggaaatgtgtggtgatcctcacgttgcaagagaaaaggagcaggtagggaaatagtcaattatgtactgatcttatgctcaataaatcagcacttaattagaaaagatgaacggggtagctacctgtggaaatgtttaaacttttatctgtaactgcttacaaaggcaaggaaaggtggcttcttgcatgactcagctttcaggttacctttttttcttttggcatagtaaattgggtccccagtttttattgtcctttcatacaatgatcaatccctagatctattatttcactaggagttgcaaaatagtaatattctaatgctatcattacaccttcatttattagctgaaatacttacataaaaagtaacttccccttgatctgttagttatccagtgacatcacccacacaggaaatgcagaatagatgaattattcccttatcagctttccaaataataaattggatcactcgcagcctttttcttgcttgtaaacttatttattataattacaaatccatgcacttattgctgttactataccaattgaagttccaattgtcctgtttttggacagtaggagcatcatgtcatctcctaggccctctgatataccctagttatgtttcatagcatccttatttgatgatatgtcagattgatccagaatcatctcatacatcttctgtccagacctaaattcaggtatttctccaaggaactctgatctctttttataaaaaaaattgttatttccagaatacagcctggatatgagaaatgctgccttactaagttggtccttgattcgtgcctttttctgtgaatacatacaggagtgctccttccttctgggttctcttttttttgagagttaaaacatatcatgacatgaatcaagttaaattatgcctctgagtttcagtttccttttcagactatttattttgatgattacatgagttagtacacagaaaatgtacagcagtttttgtgatatactttaggtgatcagtaaattctcagtgcaaaatgtgcaaagggtgaaggggggaactcccatcagtcctacctaactggatagcaagctccttaaagccaggatcgtagttctaaacctctgtgtatccaccataactcctagcacaatgctttgcatcaatcatgagctcaagaaattattactgatgaccaataaccatcatattagctgcatgaaagtgcaataacatatgcactttcaaaccaaataacaagaagaaaatctataaatagcaacctgtatcaaatatttctgtgtattgttgtaggtctgtgaaaccacaacacactgatatattgaaagacatagactaaatccagtcctaaagcaattcgaaatttccacaatataatttaaattcattaaattttcagatttctgaattcattcaagttctaaagttatcattctgggacagttcaatgtctttaagcttttaatcttctccattctaatttcctgctataaaatcaataaagtgtaggttgtaaagaaaaaacaatcatgaatccatgatgacttgtcctatccaaattgaggactataaagtagttgtttattactttgtaacttctatctgtatcccctttctcctatactaagaatcctaggtcctcaatgacaccaggaatgacagaattaaagtattatttctcctcatctccttcatcctataataccgatctacaaattgaagatgaacaatgccaacaacaaacagttttagggtccttgtttggcaattcatttttttccttaagatgtatttccttttggttgtacaaattgcaatgctttaaagcgtcttgaaacagttatttttggtatgtttagaaccctcaactagtgttttaagacatatttatgtttaggtattttatattcattttttatttactgtactttcatttattaagattttattatgaataatattaatattggctggatatggtggaatgattcattcagattggttgggactttgggtgctcacttcagcagcacatatactaaaactggttgggacttgggccataccagtgtttaagtatttctctatccccctgccttgatggatcctgccctgccatgaaaaattgactaaagtaagtttaattcattaaaatgtgattttaatatgcctacttctcttgaaagacatttgccaaggttctaaactgaattctggataaaaacaggtaatgaattctattatctgtttaaggaatgaattccttgcattcacagaagcaagaatggatgacaaaactttgtatccttcaaatgaagatgaagtggccaggtgtggtggctcactcctgtaatcccaacactttgggaggccaaggtgggcagatcatctgaggtcaggagttcgagaccagcctgcccaacatggcgaaaccccgtctctactaaaaatacccaaaaaatagctgggcatggcggcagctgcccagcaactcaggaggctgtggcagggagaattgcttgaacctgggaggcagatgtggcagtgagctgagattgcgccactacactccagtctgggcaatagagcaagactccgtctcaaaaaaaaaaaaaaaaagatgaagtatgcagagaagaaagagctttcacttacttgcatgaagtactgaagatgtgacctcaatttcacttgctgcttgatcagactgaaaggctgagacattgttggtgccaagctcactagcactagtaaatctctccgggctctgggtatgcatggagctggcactgatgtcatcacctccatgatgtagatcttgcttatcaaacactgcaaccagctagaaatgaaacacaaatgtgcatttataaataaagacatttaaattactaccaaaaatttatactactttaacataagtctacagtgggaaaatacccgagtgaccccagaatgttaagttttaagaagcaaaaccttggctgggcgtggtggctcatgcctgtaatcccagcactttgggagggcaaggtgggtggatgacctgaggtcagaagttcgagaccagcccggccaacatggtgaaattctgtctctactaaaaatacaaaaattagccaggtgtggtggcacacgcctgtagtcccagctactcagggaagctgaggcaggagaattgcttgaacccaggaggcagaggttgcagtgagtggagatcgcgccaatgcactccagtctgggcgacagcatgagactccatctcaaaaaaaaaaaaaaaagaaaagaaaagaaaagaaaaaaaagaaaaaccttaaaaagacaatgtttctgttaatgttgatgctttatttctacatttctgaagtgaatattttatagacaaaattctatggctgaaaaataatgaaactgtttgctatcacagcatgctaagatgaaagtaagtttaaatatgttctaaaatataggctatattgttaagtggaaagaaaaaatgcaaaacacagagcgagaatgtgtatatatatatatatatatacacacacacacacacgtggtataagctacacttcatataatgagaaggggatattaaaaattatacatgttatctgcacatttgtgcataagatatctaaaaaggataaaaaggaacctaatgaaatgggaatctaataaaaggaaatctaataatatgagcatgcagaaagaggtggggaagaacataactagcctaagtaactttggaaaactattttcattgttgaaagctaaagacaaaaaaaagtcccacaaatactattttctaattagtaaatttatttctcaacaagcatacggtttcacaattctcaatctactatacacacacatacacacacacacacacacacacacacacacaccaggaacaaacaaacaagttaacatattttggaaaataaaagccaattttctcactgttagaagttacaaagaaggaaaagctagaataaactcagtggtgttagagtggaatcaaaggcaacagtaagaactcacagtttttataagtaggtaggtaggtacacagtcagataggtatagacaaatgtcaatgcatgtgtgagtacaccaacatagagttcttagctctgtcaatggagagatcctagagtaaatgacattccagtgctaatgagcacacctagtgctcagatcatggtttctagtaccattctccagttaatgatgaaccagggctccctagaaatagggttaatttcagggctgaggtcagagaagatgcatgataagcctggaacactttgtgatgccaaaaataaggaagaactcaaaaatgatgaaggcatatcaaaaggaaacaggtgccaacctgaaggggctctcaatggccaatgttgagtgttgggagaaaagctgagtgttgggagagaagctgaggcagggcttggaacacgtccagggtctaggattaaaacccctcgtggtctttggaatgtgtctagacttgctggctccttgcttctagcactccctttatctcaagtagccgtatgtttcaaagaaaatgctaaaccgtcacagctgtagctcattcacttgatacaccgcttcctttcaacccccacatcttcactgcctgtttctttgtttgatcatcaataaatagtgtgggatcccagagctcagggcctttgcagcctccacactagcattggctgcatggtcccactttctcttttaacttgtcttttctcgttcctttgactccgccagacttagtagcccccatggcctggtgttgggtctgatcactccaacagttgagacaacctgaaaataaaataaataatattagcattggatcataatccaaagaatacactaaacagccatgagtccataataatataaataattgaataaataagtggtgtagaagcaacagctgtttcctactagaacattccaaataaatgcagaagtaatgatggaaagaaatcattaggcaacctccaccgtaataactgctataggtaaaaatctactcatgggtcctaggactaatgggggagaatacaatatcaaacaggatatttgtatatctctaaatgtctccccgtatgatacatttcagctaaaaagggaaaaatatttggcagcccccactgtaccaagattaacatcaccagtaatggcaacatcacgtaccatctgataaaatgccctgagaagtatgtaacattacttctgtgacattcctgccacatgaatcgtatttatttcatagactgtaccttcatttgggtttgtctgatgttgcctcatgattagatggaaggttacttcatgatgaaacattccacaaacccaaatggaagtgcagtctacaaaatatttacaaaataaatataattcttaaaaagtatcaaggccatgaatacaaaagaaataatgagaaaattatgcaaactggaggaggctgacgaaaaatgagaactacatgcaatgaggacagaaaatgggtactggagggagaattcagatgcgctctgaacattagttgactgtactgactcagtatgagtttttcacctttaataattgttctatgattatgctaaacattaacattagggataggtgaagggtatgcagaaatactgttaatattatttcaatttttctgaagtatataattatttcaaattgaaacgttttaaaataaaaattgattctatttcttcttataactaatacagctcttaaaatgttagtacacttattaaaaatcccattgagaataaggtctaaggatcaacaatgactgtcaccttgggatattcatcctacagccccatgcctagaggaactaaccttaggattctgatgagaaaaccatgcctgaagccaaaatccaccccttttctgcctccaatccaaggacagaaatatacatgtacagaattcaaatagcacacataattacaatcctcattttataaatagttttgtcacttggaacaaatgctatttccatgaatatgtacattttacatatcatcaatccatttatgaaacaacaaagagggtcatagagacatgtaaacaaacaagaagctcagaaccctgctgaggtataatataaaaacacctgattaaataatctggaaggagggtaaatggtatgaagaaatcaaaacaggatgaatagttgagccactcaaagttacagggagcaaactaagtgggaaaataaatcgttaacagttacaaaaactggaaatgtgcttgtatatatgagacaaattgtccataaaatcaacttgtttatctgacattggctggcaaggatctccctgtactagtaacacagacattcaactagattaggagtcatccagcaacttttcctgaaaatggcaaaacagtaaacatgtttggagctgtggtccacatcatctattccatattctactcgacctctgcagcatgagagcagccatagacaacacataaacaagtaaacagggttacgtttaaacaaaactttaagtataaaagcagtactgatagggtttttgcatatgttactttaattatgactttaattgcttaaagtatttcctggaaacacgaagttgttaacaagtgttagttatttttgtttgagagaatttcaagagattgaaattatcaacagaggaatgtgaaagtcgttgggcattaagctaagccataaaaactttaccctgaaaatcgtgggggtgtccttgaatgcccacgagtttaatttccattttctgcctgaggttttaaggagtatgcaggattaggagggtaaacactcatagctcattagtctaacagtgaagaaaccatgagggcctagagtaatggaaaggcaatgaagtgaaaagacagttaaaatgtgtaattttccaaatacagaactgagatatttaaaaggattgtatgtggtggttgggtgccattacaaaggaggtggatgaattttaggcgtctagatttgtggtgctgatggttgggcaggggacaagcacacagggaaacaaggaaaaaagatgtatttaggtttaggtaaaaatatcacatgctcagtatccaattcctgttaaacacctggagatgggagtctgtggtgcaaagggagttcgagtttaactatacacgattgggtgatgctggcatgcaaggagagatgaagccatggatttcattaaggaccccaatctgaatgtggaccgcacacaagaatcagaaccaaaacctggacacagccaagactgcaggtttctcttcccttgctccaaatccactttcagaagaattagagaagaattgactaaagaatgtaagtaaactccaggaaacagggttccacagaagctggggaaaggtcagtacgtggaagagagagatcagtagtacctgctcgctacaaggaggcgcctccaaatgtcaatgcctattttcaacaagtgggacccaaagtgattcatgccagtgctctaaaatacacctgacccttgaacaatgtgggggatatggatgctaaccccccacagtcaaaaatccaagtttaactctcaactcccccaaagcataactcctaacggcctgcggttgaccggaagtctttgtcactaataatacaaaaaattaagacctattttgcctgttattcacattacacactgaatatgctgctcccagcggaggccgagactcctgcccgggcaccccctcacagcccccactccagcctccccagactcaccctcggcggggccaccttcttctcatttcagtctggggccacattctccgggcctgcggggcatggcaggaggcaaagccaaaggcgaagtggccacaaattccggtgggggcgctggctcctgccccaccccagcatctataccctgagtctgataggacgagaaggaacatttcagccagccctgattgggtcatattatccaatcagagttgttttgcacagtggctctcatccaatccgaacatgccttacaggatatctagttaaataagtcattataaatagttgctccgtgggctttccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaaggcaggagggccccagcggtgggggcgggggttgcgcgccggggagggcggcctcaggctgggagcctggcagatcgtctgactctccccgagccccatcccaggccgagccaggacccctctgatgcacaggcgtctcaggagcccgtttctttcttgaatccggggcccagtgcggcttgaacctagcccccgacctcctcctcgccctctcagagtccgctggggtgggcgctgaaggagcccgggtcggagaggagccctccccttctctcctgcgtggaagccctgcagcctccgtttcttttgggactggggtccggggccttctgcctgacccggggtgagaaagggagccctgatcaggacccggtgagagggcgctggagcccgggagcggcaggagccttgagcggcagcccgggaagaggatggggtcaccttctgccccaggtcccccactgccaggatctctgtcaccttctgggggtcctgtcccctggggtcccaccccccgggctgcctgtgggtatctctcatctggaactggaaataaccctcttcatagtacggcttagcaaatatttattcgcccatgcaccccccttttttttccttcatagtgttctttttgtcttggatcatttgtgtttttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcattgatgtttgttatctttattattgccttcatcctgtattctttgcacttgatttttctttcttgattcttgagaaaaaagttgaggtgccgggcacgttggcttacgcctgtaatcccaacactttgggatgccaaggtgggtggtcaggagttccagaccagcctggccaacatagtgaaacccccatctatactaaaaatacaaaaattagcagggcgtggtggcagacacctgtaatcccagctactcgggaggctgaggcatgagaatcgcttgaacctgggaggtagaggttgcagtgagccgagatcgccccattgcactccagcctgggcaaccgaacaaaacttcttctcaagaaaaaaaaaagaagttgaggtgattgattttcagtgtttctggactcctgccctgcagagatcctcttgctgtaacctgtttcatgtgaggtagagtttagaaaatatttattggcctctgtgccttacttttcttcatatactcttcttattttgttgatttatctttagggatttttttccttatgttaaattgaaggacttattgttaaaatctgtaagttagccctttattggcttatttttgtcataggttcttgttctctagtttgatttttgttgtttcatttctttgtgttcatagttgtatatagtaatctggttgataatgatcttgtatgcagtagctttgcttaatttatttattaattgtaacactttatgtcatgttaggctgtgctgagtgcttctgggagcagccaggtttccatgaactcccagtttactctaaatactctagcagcccacatgtgcacacactggataatggtcatgcatgtagagcaatgatgctggggaggcaccgactctgtcattctgtgaatccaccgcacaatcacaaacattagcattaaaataaaatggactgttaggcaactgcaaaggactaatgcacctatgtggcacaaatgtgtctttccgtattcaaagtacttgtaagagcttcaagttcctcatactcagccactgacctcagggttcttggtacacaggcatacatgtgcagacacacatacaggcacacatatacacatgaatgcacatatgtgcacacatatttacaggcacatgcagatgtgcacacacagacctgggtgagaaagtcagatgtacatggaacagcccctgctttgtaagctgtctggctttgtagggagaaagaggtgaaacaacacacttgttatcttggaagaggagatgaagggagctgagctggatatgtccagtggggagaaagccaggagccactccaccgaaaatcgaggtctccacatggatgatacccacaaaacattggcaggaaggacacagccagcaccacatcagtggtgactttcatgagtgtcaactgtggccatccaaattaaaggcctggcaatgggataagttagcaactgaactttctgtatgttaccttattaactttctgtatattagcttattaactttctgcaatcaaatgctgattaagcattttctgagccaaaagctttgtgtaatttgaatctagtgaaaaaatgttatgcgtttaacactataacttgagatctaaaaacaaaaaaacaattgcataagaattggtcagataccttgtctttgaaacatactgaagtcttcaaaattaatctgatagctctgcagttggtatgtggcataagaaaatatttggcatgaaggggagtaacacaccacatgaattcattcattatgaagaaattcattatgaatatatgtgggcaaattattaacaaccctcccaaaagcagaaagctcagactcaggaagatccatttaaatggagtgatttgggagatgatttcaagcgcaactctgcattgactcagcatttattaagtcatacagcaggctactggaggcctcactgcagcctgggctggtattcagtgtcctcctccttccttctcagtagacttccttggccttgataataatacgtgttaacaaacacaaatctcaaaatacacataatgtttcttcccccacaagccagggtatcagctctgcaaatcagatgaccccaaggtcagtggggttgaccagggacaccattctgcattcctcctcagcttccagatcctgaggagctctggggccttccttctggacagggaacatgtctgcctggcttcctcagccaggtacgggaggctttggggacctgtgtctgtctctgggaaggaggaaggagcctgtggcatcttccttaagcaaaagcacatccagcccatggccaaacttcagagtggggcgaggggcccagcacagctcctccgttcctgcagcagagcccagaaaacacatctgatgttgtggctgcctcaaacctacaaacaccatgggtttgaagtgtcctgttgacatggccatggccactttccccgtggaccgtggcaagtttttgtttttggtttttgttgtttgtttgagacaaggtctcactttgtggcccaggctagagtgcagtggtgcaaactcggctcattacagcctccacctcctgggctcaagcaatccttccacctcagcctcccaaagtgctagaattccgggcttgagccaccgtgccaggccttgtgtagaagtattatacattatctttaaaatgtagtttagtgctaataatctaaaattgtgttgccatttactattaatatgccctttgtggtgcatctaataaaatgctttgcttcataacctgaaacaaaaaaactttcactatatttacttgatcagatcaacaactatagaagtcttagaataatgatattcttactcaaaagaaaagcaacaactcatctttaatgaaactgtttctgtgttttattagtggttgagaaataacacattccttcagcagtggcagcagtcagataccatatgaattttttatttttttttactttgataaatcctgaggctctgttgaggaagaagcttccacagtaggccctaggagagctgcagccaccatgtccacactgtgttatgcacaaatgggaatgtagtttcccagagaaaacaacttctgtgggtagatttgtgatcgaagtttgtgaatagctttaaaaaatccttatgaaggccaggcacagtggctcacgcctgtaatctcagcactttgggaggctgaggcaggcagatcacctgaggtcagttcgagaccagcttgaccaacatggagaaaccccatctctactaaaaatacaaaaattaaccaggcatagtggcacatgcctggaatcccagctacttgggaggcagaggcaggagaattgcttgaacctgggaggcagaggttgcagtgagctgagatcgcaccattgcacacaagcctgggcaacaacagcgaaactctatcttaaaaaaaaaaaagaaaagaaaagaaaaaaaaaggctgggcatgatgactcatgcctgtaatcccagcactttgggaggctgaagcgagcagatcacctgaggttgggagttcaagaccagcctgatcaatgtggagaaaccccgtctccactaaaaatacaaacaattagttgggcgtcgtggcacatgcctgtaatcccagctactcaggaggctgaggcatgagaatcgcttgaatctggcaggcggaagttgcggtgagccaagatcgcgttactgcgctccagcctgggcaacaaaagtgaaactccatctcaaaaaaaaaaaaaaaaaatcctcaggaagattatttacttataatctcctccttccttaattagcagtctcagcatttctgcaataaccaagtctcagcatccagtgaagcagcctgcaacatgcgggagctcagggcattgccactgcacatggggcacctggtgggactttggcaaggattttgtcattaacactgagcaaaactctacgaagacagaggcattcttttagattaaaaactaacaacataaggcgggacatggtggctcacacttgtaatcccaacacttcgggaggtcaagggggacagatcacttgagctgaggagctcaacaccatcctggacaacatggcgaaacccgtctctactaaaaatacaaaaattagctgagcgtcatggtgcacacctataatcccagctattcaggaggctgaggtgggagaatcgcttgaacccaagagcagaggtagcagtgagctgagattgtgccaccacactccagcctgggcaacagagtgagacgcttacagaaaatctttaatttctatagaaaatcttcagtcttctatagaagaaaattaaatattacaaaattgaagattagaaaattacatagagagccgggcatggtggctcacacctgtattcccagcactttgggaggccagggtgggtggatcacccaaggtcaggcgttcgtgaccagcctggccaacatggtgaagccccgtctctattaaaaatacaaaaaattagccaggtgtagtggcgggtgcctgtaatcccagctactcaggagactgaggcaggagaatcacttgaacccaggatgcggaggttgcagagagcagagattgcgccactgcactccaggctgggtgacaagagctaaactctatctcaaaattagagagaaagagagagagagacagagagaaagaaaagaaaagaaaaagagagaaagaaaagaaaaaagaaaagaatgattgattccatagagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcagacagggaccttgagtggtggggggctgagagtgctgagtgcacctccccgggcagacaagaagaaacttgcaagtgcaggcacaagatgaggaatcacagtgaaacttaccacaacattcagcctctattcaggagatacttcacaacacttgccaggtacttttctaggcactggacataccgcaaataataaagccataaaaaaaaatatgtccctgtggaacttgcaattttgtgcagaagagcaaatagttcactaaagaactaagcacaactggccatgcatggtggctcacacctgtaatcccagcacttagggaggctgaattgggtgaatcatgaggtcagtagatcaagaccatcctggctaccatggtgaaaccccgtctctactaaaaaatacaaaaaaattagctgggcgtggtggcgggcacatgtagtcccagctactcaggaggctgaggcaggagaacggcgtgaatctgggaggcagagcttgcagtgagccgagatcacaatactgcactccagcctgggcgacagagtgagacttcgtccaaaaaaaaaaaaaaaaaaatagaaaagcacaaccatacaatgtgggaaggtgtcaaaagttatggaacaaaatgaaggaaaggggatagggactgctgaggggtgggctacaatctgaattgggggttaggaggggatggagtgagaatgttctatttgatcacagccttgattcatgtgagagatcctggaggagaaagtgggcaaaagccgcccaagtggctgtagcaggctgggtgctgcattacatagggcacattaagtgaaatgtgatggctattttgtgtaatcctttaaaatcccaatagaaataggactttgtgggaggactacattttgaaataattattttcaaaaatagttatttcaaaaaaagcacagcagttgcatcctattgaatagtgggaacactggatgataagttaaagtatcattttgtgttaaaatattgaagcaaatatggcttggtgtggtggctcacacctgtaatcccagcactttgggaggccaaggagggtggatcacttgaggtcaggagttcgagatcagcctggccaatagggtggaatcccgtctctactaaaagtacaaaaattagccagttttgttggtgagtgcctgtaatccaagctactgaggaggctgaggcaagagaattgcttgaacccaggcggcagaggctgcagtgagctgggattgtgccattgcactccagcctgggtgacagagcaagactccattaaaaaaaataataataatattaaagctacccattaaaaaaatttgaaagtcccagaaatgtggcaagacaaacaaccctattaatggccctaatgaagccctatagatttctcagaggatcctccatgtgttagaaccatacctagggctgcagctggctaagacattctccatcagcctctgggatcaaaggcggggtgtggaggttgtctggatgggaccatgagcctccctctcagtaaaacacaagcacaagggcgacatccctcttggtttttcgtaatgtaggaacacaggcagagcttagtgttctcagagcctctgagatcccgggcaaagcgtttggtaagatgctgcagatatttccttctaaaaataaaaactcccttggtaaatgctcaggcatctcaatggccacaccagccctcatatgtgtacccaactcccttcatttgcctctgttcccactgaaattttccatgtgaaatctgggaagggatgggacagcttgcataacttagttgatgactctcccacaatcttatagacttcactaatctttgaggctcttcactgactcatgtgacaaagtcacttaattctgtaaatttgggccagttcattttgctagctctcagtttgctcatctgtatgcaagaagtttagtgtaggtaaaccaaggacgccaatatgcctgtctctccagaaggtcaataacagaaaatctgagctggggggtgcagttccaagtcccaattccatgcctcaaagatcagctggttgtctttattcatcaccaggcacacatctccttgatactctcaatatctaggcataaaatgtgacaagacagattatctctgtgttatttttttctccattcctcatcacttgtatttccttaactcattgaaatcagttttccacattttttgaaggagagtcttttggcaaagatgtgaattatctacaagcagctgagagaaatggctactgccctcagtgtgctggttataagtttccaagtgatgaataaaagatttcctaaggcatcagtttccgtgatggtgtgttcttttttttctcttgggcacaagggaatgagcagagcaggtacacctctgggtttgttttgtttgtttttagcttatgtacaaaatcaagctctgtttttcattgaaatatctttttttcttgtatcagagaagagttgtaaaagactcattgtgggttcagggaagaatgttttaacatgcaaggaaatgttgcaaaattggaaagaggacataattccacaaaactaaatacaactgggggaatttttaggatactctgagttaatcttattatttgcatcctgctaaccccaatcaaataataatttagaattgtttaatttactaaactgcacattcaattgactaaactgtagaggatgagcaagtgtcaacaataattaccctccttatgggctaacacaacaggctccagtgagtcataatacacacattcagaggtggtccaatgcagtcccaccatagaaatccttcccatgcttagccactgttgtcattaatctctccaaactcaaaccatggttcaaacacagttgtcccttggtatccagaggattggttccaggacccactttggacacccaaatctgctgggaacaggccctaagcctgtcataaacaggccttaaagaaactggccataaacaggatttctgcagtaatgtgacgtgctcatgatggctatgacacacactgctagaagatattggtttattggagcagggcaaggaacacctggcctacccagagtggaaaactgctcaaaccacaaacaacagcatgagcggcctgttccataacaacatgtttttgctgcagatgatcatccagggactgtttctctgctcctcactaagaatgtttgtttcctgtaaagaatgcttttagctaatctataacctatagaaacaatgcttatcactggcttattgtcaataaatatgtgggtcaaactctgttcgtggctctcagctctgaaggctgttatccccctgattcccactttgcactttatttctgtgtgtttgtcttcattcctctagcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggtaagtaagacggggagcttggaagcatcagggtaacaatgggacaagggtcgagcaggcatgagtcttatttgagtctgttttggcagctcctcagaaaagggggaaggaaggttagtactagccgacttatgcagctttgtagtgtggtagagaaatattgcccctggtttctggaccaaggaactatgaatatagagatctgggaaaaggtagccagagcactgaaaaaggcatatagggatggtgctgaggatattcctataaatatctggtcagtgtgggctctggttcatcccaccttggagcctttccacacagatcatgatgaggaggaatcagaggaagaaggagagtataatgaagtaacaaaagaggtgacagagcagttttgcttgccagctaaagcagcaaaggagggaggtttgtccctccccctctgtaccccctcatcattttgaagaaaaagagtggcctgaccctccgaatctttcttttctggaggacgctgggcgaaaagtagttgcctcagtgactgttcaagcagcacctcaagcgaccactctcagttctattcaggcatggatccagcaagctggatgagagggtgatatggatgcttggcagttccctgttagaatacacccacctgatcaacaggggaatattatagctatgtttgaggcttttccttttaaaatacttaaataatttaaacatgctattaatcaatatggaccaggttctccttttgtaatgggactgttaaggaatgttgctgtctctagtcagatgattcctactgactgggatgcttttactcgagctagtctgactctggctcagttcttacaatttaaaacttggtgggcagatgaagcttccattcagtctgctcgcaacaccaaggcccaacctcaaattaatataactgcagaccaacttttgggggtttgtggctgggcttgtttagatagatgcacaagtggccatgcaggatgatgccatagagcagcttagaggagtgtgcattagaggttgggaaaaaaatcacttcaggaggagaacaatacccttcttttagtgctgtcaagcaggggcctaaagaaccttatgcagattttatagccaggttacagaaatctcttaaaaaggtaattacagattcgcctgctaaggatatagtgttttggttattagctttcgacaatgccaatcctgagtgccaagctgctctgtgacctattagaggaaaagcacatttggttgactatattaaagcttgtgatggtatcgtaggtaatctgcataaagctactctgctggcccaggcaatggcaagaatgagagtgggcaaaggaaatactccatttcctggagtttgttgtgggaagcatggtcatactaagaaagaatgtagaaaaaaatcagtgagtcagactgccagttgggggaaaatagaaaactgctgagcctgaaatatgtcgaaaatgcaaaaaacgaaaacactgggctaatcagtgtcagtctaagtttgagacagatgggaacctgattttgggaaatgccatgaggtgcctgtcccaggccccattccaaaccagggaatttccagctcaggccactccctcaccccgtacaatgcctgtcccccgccacagccagtagtgccacagtagatttatgctgcacaaaagctgtgagccttctgcatggggaacccccacaaaaagtgccaacaggagtctgtggacccttgccagcagggacggtaggattacttctaggtagttctagtttaaatttaaaaggagtgcaagtacatacaggagtcattaattcaggttacaatggggaaatacaaattgttatatctacttctgttctctggaaagcagagccaggagagcatatagcacagctcctggttgtgctgtatgtggaagtggggaaaagtgaaactaaatgtacaggaggattttgaagcacaaataaataaaccaaagcagcttattgggtgaatcaaattactggtaaacatcctacctgtgaaataactattcagggcaaaaaatttaaaggattgttagatacacgatcagacatttcaatcatttctctacagcactggccgtctacatggccaattcaacccactcgatttaacacagttgaagttggtaaagcctctgaagtatatcaaagcagtgatattttgcatcatgaaggactcgatggacaatctgggactattcaaccaattgtaacttctgtacctgtaaatttatggggaagagatttattacagcaatggggagcacaaatgttaattccagaacaattatatagctctcagagtcagcatatgatgcaagagatggtgtatgtgcctggcatgggattaagaaaaaatttacaagggttaaagaaaccccttcaagtgaaaggacagaattctcatcagagttaggatatcatttttgatggaggccattgttaagcctccagaacctatgcctttaaaatggttaacagataagccagcttggttagaaaaatggcctctgagtaaagaaaaactggaggctttagaggacttagttactgaacaattagaaaaaggacacatagttccaacattttccccctggaattctccagtccttgttattaagaaaaaatcacataaatggagaatgttggcagatcttagagccgttaattcagttatacaacctactggggcattgcagcccaggttgccttctcctgctatgattccaaaaaattggcctttaatagtcatagatttaaaagactgtttcattactaactccttagctgagcaagactgtgaatggtttgcatttataattcctgcagtaaacaacacgcagcctgctaagcattttcactggaaagtgttgccacaaggcatgttaaacagtccaacaatttgtcagacttatgtaggacaagcaattgaacttactcataaaagatttgtcacagtgttaaattattcattatatggacaatattctttgtgctgcccccactcgggaaatattactccaatgttatgatcacttgcaaaacccgatttctcctgccagtttaattgtagctcctgacaaaattcagactactactccttacttctacttagggaccttagtaaatgacactaccattgtgccacagaaagtaaccatacgtaggcctcaattgaaaactttgagtgactttcaaaaattactaggggacattaattggacacgacctgctctaggcattcctatctatgccatgagtaatctattttctatccttacaggaaatcctagtctcactagccctcagcaattaacaacagagactgaggcagagatacagctgattgagaagcaagtgcataaggctcaaataaatagaatagatccagaaaagactttagacttattgatttttccaactcagcattcacctactggtggtgttgtccaagagcaggacttggtagaatggctttttcttccacatagtaattcatggactctaactccttatttagatcaaattgctactctgataggaaatgggagaactcaaattgttaaattgcatggatatgaccctggaaaaattattgtccctcttacaaaggcacaaatacaacaggcctttataaatactcttaattggcaaacccatttagctgatttcatgggtgttcttcataatcactttccgaaaacaaagttatttcaatttttgaaattaactaattggattctccctagaataactaaatttaaaccaattgaatgttctgaaaatgtttttacaggtaggtctagtaatggtaaagcttcttattccagatcaaaaaataaagttttccagacatcctatacttcagctcaaaaagcggagcttgtagctgtaattgaggtgctgactgcttttgagatgcctgtcaatgtaatttctgattctgcatacatggctcattccacacaattaattgaaatgctcagttatgatttcatacagatgaacaactgatgactttatttacccagttacaaactgcagttaggaatataatgcaccctttttacattactcatattagagcttatacaccccttccaggacctttaactacagggaatccagtggctaaccacttagttgccacggcattatctaatgctaaacactttcacactttgactcatgtaaatgcctctggtcttacacaaagatataatattacttggaaagaggctaaagccattattcaacaatgcccaacctgtcaaatgattcattctctgtcctttactgggggtgttaacccctgtggattgcaaccaaactgtctttgacaaatggatgtcactcatgttccttcttttagtaaattggcctatgtgcatgtatgtgtaggtaacaatttctcactttgtttggcctatctgtcaaatgggaatcttctgcctgtgttaaattgcatcttctgcaatgcttcacagtcatgggtattccagctttggttaaaatggacaatgccccaggatatactagtcaaactatggctacatttttctgtcaatggaatattaaacatatcactggcatcccgtataattcacaaggacaagccattgtgaaatgaatgaatatctccctaaaatgacaattgaataaacagaaagagggagacaatgactacgggactccacatatgcaattgaatctagcattattgtctttaaattttttgagcctgcctaaaggccagatgcaatcagcagctgaacagcatctacagaaaccggctgcagacagaagcagagcaactggtttggtggagagatccgataacagaaagttgggaaataggtaaaaataacatgggtagaggttatgcttgtgtttctccaggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatggtagctatgatggctgtgctcaccattgccatgagtattcccccagcacctgctgaaacaaaaaacattatacttattgggcatatattccttttccaccagtttcatggccagtgacatggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgaacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctcaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgaaggctgtgagacccctgatttcccacttgacacctctatatttctgtgtgtgtgtctttaattcctctagcactgctgggttagggtctccctgaccgagctggtctcagcaagtggagtccattgtgggggctcaaatccaggttgaagggtcaccggagcaacatttggaaaggaaaactagctgaaggacatgtgaatactcttaaagcaatctccttggtgagtaagaaggggcgctcggaagcgtcagggtaacaatgggacacgtttggggtctggtttgtttcaccttggaactttttcacacggatgatgaggaggaaggagagtttaatgaagtaacagaagagagtacagagcacatttatttaccagctaaagctaaagcagcaaaggagggagagattcatccttacccttctgcaccccctcatgattattttgaagaaaatgactttcaagatctttcttttccagaggacactgggcgaaaagtagttgccccagtgactgtttgagcagcacctcaagcgactgctcttagttctattcacgcaggaattcagcaagctagatgagagggtgatttagaggcttggcagttccctgttagaatacaccacccccagatcaacagggaaatattatagctacatttgagccttttccttttaaattactcaaagaatttaaacaagctataaatcagtatggaccaggttctccttttgtaatgggactgttaaagaatgttgctgtttccagttggatgattcctactgactgggatgctcttactcgagcttgtctaactcctgctcagttcttaaaatttaaaacttcgtgggcagatgaaactgccattcaggctgcttgcaatgcccaggcccaacctcaaattagtataactgcagaccaacttttgggggttggcaactgggctagtttagatgtccaaggggtcatgcaggatgatgccacagagcagcttaacagagtgtgcattaaagcttgggaaaaaaatcactataggtgtagaacaatacccttcctttagtgctataaaacagggaccaggagaactataccttgattttatagctcggttacaggagtcttcttaaaaagatgatgcagattcggctgctcagaatatagtgttgcagttattatatttcaacaatgctaatcccaattgccaggctgctctgcaacctgtcagagggaaagcacatttagttgattatatcaaggcctgtgatggtatcacaggtaatctgcataaagctactttgttggcacaggcaatggcaggactgagagtggacaaaggaaatactccatttcctggagcttgttttaactatgggaagcatggtcatactaaaaaagaatgtagaaaaaatcagcgagccaggctgccagataggggaaaaaagaaaactgctgagtctgaaatatgtccaaaatgtaaaaaaggaaaacattgggttaatcattgtcactcttaagtttgataaagtaggaaacccgattttgggaaataccatgaggggcccttcccgggccccattctaaaccggggcatttccagctcaggccattccctcacccctgtacaatgtctgtcacccaccaccgctggtagtgccgcagtagatttatattgcacaaaagctgtgagccttctgcctggggaacccccacaaaagatcccaacagaagtctgtagactcttgccagcggggacaataggattacttttaggaaagtctagtttaagtttaaaagaggcacaaggccaggcgcagtggctcacgcctgtaatcccagcactttgggaggccgaggcgggcggatcacaaggtcaggagatcgagaccatcctggctaacacagtgaaaccccgtctctactaaaaaatacaaaaaattaaccaggcgtcttggcgggtgcatgtggtcccagctacttgggaggctgaggcaggagaatggcatgaaccagggaggtggagcttgcagtgagctgagattgcgccactgcactccagcctgggtgacagaccgagactccgtctcaaaaaaaaaagggggggggcacaaatacatacaggagtcattgattcagattacaatggggaaatccacattgttatatctacttctgttcgctggaaagcagagctaggagagggcatagtacagctcctgattgtgctgtatgtggtaatgggaaaaagtgaaattaaatgaacaggaggatttggaagcacgaatgaacaaggcaaagcagcttattgggtaaatcaaattactgataaacgtcctacctgtgacataactattcagggaaagaaatttaaaggtttggcagatacaggagcggacatttcaatcatttctctacagcagtggccatccgtgtggccaattcaacccactaaatttaacatagttggaaacggtaaagcccctgaagtatatcagagtagttatattttgcattgtgaagggcctgatgaaaaacatgggactattcaacaaattataacttctgtacctataaatttatggggaaaagatttattacatcaatgaggagcacaagttctaattccagaacagttatatagacttcaaagtcaacatatgatgcatgaaatggcgtatgtccctggtatgggactagaaaaaaatttgcaaggtttgaaaagtttccaccaaagattaggatatcatttttgctggtggccattgttaagcctccagaacctatacctttaaaatggttaacagataagccaatttggatagaacaatggctgctaagtaaagagaaactggaggctttagagaaattagttactgaacaattagaaaatgggcacagagctccaacattttcccatgggaattcaccagggttttttgtttgtttgtttgtttgtttgtttcataattaagaaaaaatcaggtaaatggagaatgttaactgacttaagagccatcaattcagttatacaacctgtgggagcattacagacaggattgccgccttctgctataattccaaaaaattgccctttaatagtcatagatttaaaagactgtttctttactatccctttagctgagcaagactgtgaacggtttgcatttacaattcctgcagtaaacaacctgcagcctgctaagtgttatcattgcaaagtgttgccacagggcatgctaaacagtcccacaatttgcctgtggggcaagcaattgaacctactcgtaaaaaattttcacagtgttacgttattcactatatggatggtatactttgtgctgcccccactggagaaatattacttcaatgttatgatcacttgcaaaaatcgatttcttgcactggtttaattatagctcctgacaaaattcagactactacttcttaatcctacttggagaccttagtaaatgacactaccactgtgtcacagaaagtaaccattcatagggatcaactaaaaacattaaatgactttcaaaaattactaggggacattaattggatacgacctgctctaggcattcctacccatgccatgagtaacctgttttctatccttagaggaaatcctagtctcactagccctcggcaattaatgatggaggctgaggcagagttacaactgattgagaagcaagtccataaagctcaaataaattgaatagatccagagaagactctagatttgctaattttttcaactctgcattcacctactggtgttattgtctgagaacaggacttagtagagtggctttttcttccacatactaattcatggactctaactccttatttagatcaaatcactactatgatagggattgggagaactcagattgttaaattacatgaatatgatcctggaaaaattattgtccctctcatgaaggcacaaataaagcaagcttttataaatagtcttacttggcaaacccatttagctgactttgtgggtgttctcaataatcattttcctaaaatgaagctgtttcagtttttgaaattaactaattggattctccccaaaataactaaatttaaaccaattaaaagtgctgagaatgtttttacagaagggtctagtaatggtaaagcttcttattttggatcaaaatgtaaagtttttcagacgctctatacttcagctcaaaaagcagagcttgtagctgtaattgaggtattgactgcttttgatatgcctattaatgtgatttctgattcttcatacgtggttcattccacacagttaattgaaaatgctcagttacgatttcatacagaagaaaaactgatgactttatttacccaattgcaaacagcagttagaagtagaatgcaccgattttacatcactcacataagggctcatacacatcttccaggatctttgactgaagggaatcaaatggctgatcgcctagttgctactgcagtatctaatgctagacactttcacagtttaacccatgttaatgcctctggtctcaaacacagatacagcattacctggaaagaagctaaagctattatccagcgatgcccaacttgccaagtggtacattcctcatcttttacaggaggagttaatcctagaggactggaacctaactcttttggcaaatggatgtcacacatgttccctcgtttgggagactagcttatgtacatgtatgtgtggacaccttttctcactttgtctgggctacatgccaaacaggagagtcttctgcctgtgttaaatgtcacctttgcagtgttttgcagtgatgggcattccagcttccattaaaacagataatgccgcaggctatactagccaaactctagctacatttttctctatgtgggatattaaacacattactggcatcccatacaattctcaaggacaagccatagtggaaagaatgaatctctccctaaaacagcagtcgcaaaagcagaaagggggaaacagaaaatatggaaccctacagatgcaactgaacctaggattattaactttaaattttttgaagctgtccaaaggccagatgttatcagcagctgaatagcatctacagaaaccagctgcaaacacagaaacagaacaactgatttggtggagagatccaataacaaaaagttgggaaataggtaaaataataacttgaggtagaggttatgcttgtatttctccaggccaaaatcaacagctgatttggataccatcaagacacttgaaaccttatcatgagccagatcccaaggaagagattccaggaggatcccgaggaccccccccccccccgccattgcggccatgtcgaggctgatgctaaggaggatcccaactgtcatgagcaacacctgtcgagcacagccacccacctgggggcagatcaagaagctgtcacagatggtggaagaaaacctgaggaaagcaggacaaccagtaacaatgagtaatttagtggtagctgtgatagtgatgatcaccactgccatgagtattctttcaataagggctgacaaagagaacagttatacttactgggcatatttatcaatcttggctggcaatattgcctggatgcaatcactctgacacagttacacacgctttctgatctcaatatttaccataataaatctgctcctataaatgaggcataccaccttcaaaaacctatttgtaaacaaaatggaacctcaccagaaataatgaacatacttgttaaggaagatagcattgcagaacaggcagaggtgctgcacaatgattcctatggaatcattattgattggtctcctaagaggatgtttagcttgaattgcatctctgagtctgtgtgccactgccacagtatgctcagatgatagaaatgataagaagtatggcaaaagttcctattatctggaaccatggtgggatagtggcatctcaacctcaaatgatatggcccgctctagaagctaaacatagggatgtgtggaaactattaatagctcttaataagatcaaaacttgggaaaaaataaaaaagcatccagaaagacactctacaaacttgtctttggatattgcaaaattaaagacaaatatttaaagcatcccaggcacacctgaccttaatgacaggaactggagtgcttgaaggagttacagacaaattagcagctagtaacccattaaaatggataaaaacacttggaagtgctgtgatttcaatgatgattgtgcttttaatctgtgttgtttgtctttgtatagtcagcagatgtagatcctgactcctgctagaagtagctcaccgtgacaaagctgcccttgcttttatcaatttgcaactcagagaagggggacatgttgggagcaggccccccaaaatctggccataaactggccccaaaactggccacaaacaaaatctctgcagcattgtaacatgttcataatggcctttaggcccacactggaaggtggtgggtttacaggaatgagggcaaggaatacctggcccgctgagggcagaaaaccgcttaaaggcattcttaagccactgacagtagcatgagtgatctgtgccttaaggacatgctcctgctgcagttaactagcctaacatattcctttaatttggcccatcccttcatttcccataagggatacttttagttaatttaatatctatagaaacaatgctaatgactggtttactgttaataaatacatgggtaattctctgttcagggctctcagctctgaaggctgtgagacccctgatttcccacttggcacctctatatttctgtgtgcctgtctttaattcctctagtgctgctgggttagggtctccctgaccgagctggtcttggcaagggcttaatttatccctaagtccaatctagctgtttatttatatcctcataaactactaaaacacctgttgtgggttgtgcatggtggtcgtgcctgtaatcccagcactttggggggctgaggtggtgagttgagattgtgccactgcactccagcctgggcaacaagagtgaactctgtttcaaataaataaataaataaataaataaataaataaataaacacctgttgtgaagtcttagggaaatgtgcctggctctggcttctccctgcttgggttgttccaattatgccaagataagaggcagtgatttcaatgaaagaaaactatctcacagtctattttgtttctttctttctttttcttttttttttttttttttgagacggaatctcactctgtcacccaggctggagtgcaatggtatgatcttggctcactgcaacctctgcttccgaggttcaagcgattctcctgcctcagcctcccgagtagctgggattacaggtgcccgctaccacgcctggctaatttttgtacttttagtagagacgagttttcaccatagttggccaggctggtcttgagctcctgacttcaggtgatctccccaccgcagcctcccaaattgctgtggttacaggcgtgagccaccgctcgcccagctcagttttagtctccccttgagaaaaacagttttatagatatattctcactcagctgatcctttctcatttcttgaggaacatttctggtattagtttttaccacagtaaatctgctacagtgactgagcccccagccaatatgaactgtataggcacatccactgttttccactgtgcagtgtcccatgaaccaaagggtgaaaattgtgcctgagtgacgaatttgaaagcctaatctagtactccaaaagttttatactccattcatgtgatagaaaagatccctagtgagaatgtagagataatatgaaaaatgtagagataatgtgaaaaaaataataacaggtccattgttaaaaatttcccacacaaattttaaagtataaaatgcctggcaagaaaatgtttaaagggaaatgacacttgtggaattcaaatcactctcggagcacttacagcctctcttagtcggtacggtgagctagataccctaacaaacaatttgtttccttcctaaatttcaaatgatattagtgactgattttattataatagtcacaggcagtgtgagccagaattatttccataccttctgttaaaatttgtggcattccgatccttttttcccctggatctgcttttattgttgttctttttgttttggaaatggggagtgtgtgaaagtcaataaagctgttgaatttgtctcctgtacgtttagcatccaagccgctcaaaactgccccaggtgtgaaggagtgagaagggatttgcatttctgcctttctttttaactttccatgtatctgctgtcaaatcttcatatgctatttcccacacctcccatttggaaaattcctgtataaatccatcattttactaaatgcattgttttagaactgaactgacccagcactacatatgttgtagaatctggacaacttccagccaccttcttacctctgattcttgagtctggtattcagctggttggtgctgcatacaagacttggtttaaaccatggggggtgctttaaaccacacccatggcattgggttcactgctggaaacattaaagaatttaagattctactatgcgatttttgaattttttcaacttcatccaagcagacataggtaattgatgtgcagaaacatttcagaaattaggtcagcagacattcagttgtccagggttgccacccatgtgggctgtgctggatactcaagccatgtgtattcattaggtcctttggggcttgaccccttgttgagaagctggcacagcattagacaactataatgaaaaagaattaatgcatactatattgtgtcatgaatctgtgggtcacattattccaaaatatgtattttataattgtatttgactgtgagagaaattaatgtacccatggatgagtatatactgattaaaacaataagaaacagactataagtttattttttgattacgtgattttttaaaatgggaaagtcactggttacatcatataattttaaactttatatcacagaaggtagtaagaagttctagtatcatttgtttctcacagacgctgagttcttgctaaatacattatgatacaacttttaacaaaaacattactgcaaatacatagtaatgcaaatctcagttaaaaaataaatctctgaatactgtgatcaaaacactgacaatttcagagctgattctatagctcaaagaggtttgatgactagaaaacttaattgcaataaaagacacttccatatccctgttgacctctgtgtctcctctttcccctatctctgctcacaggcgccatatggaccatggttctcacggcagccctaaggcagtcacaggtagaggctccctctagggcactacaattcccatccttggagcgtgcggccagtcttgggcagctccagaccccagctgacctcacttactgttgccagggaaaggccctgtttgtggacttcttgctgcaaggggtggctcgcagtgcatgtgattcctcccatcaggcaaactggccatactctgcagatggtaaactgcatgtccagggagcataggccaagggtattcacatggagcttaagttgaagccctggccaagctcttagtgtctcccattcttgactggacaacagagcaatgaagggctccttcctgacagttcataaatgttccttcataccacagtgagattttgctactaacaccatgtcttcgttttctgaaaatgacctgtgtgtttcgtttcatagacttcacaatcaggagagaacagataattagggtgggttgggtcaggtgcagttctttccagagatgacactggggaccagatatgcctccttactcttcaaaatcaacctcatataaaacatcaatttcctgtctttagatgatctcaatatgtagtgtggagctgtttctccctggtcctactagtctcaacttggtttagcccttaaatatttattgaaatgattaccatatctttccagtgagtcccccaggccttccagattatccaaaagattaatcctcataaatacagaccatcaccttgaaataatggcttccatccaattctgtctggtttcagaagtgctggtgccttatcttttaggtcaagtgcagaccccctgccacaatttcaagacctcctacagcccatgcccaccctgtgtatcctagatccacagtgccggctgccagggggacctgggactcaaggaaggacacagcaacctttttaaagatgtggctaaaggaaattcctgattcagaaacaaaatgataaaagaaggaaacaacatcagggatgaagaaaaatagaaataataaaagcatggataaatatgataggctagccttcttgagtttttctaaactgtgtctgatgattgaagcaaaaatttctccacggtctgatatagttcttcatgcatgtaaattatgttgtaaattgagaaggagaaatgggcctatatggaggtgaagatcctgcacatcacatggcagaatgtggacaccagtgggctgcaacaagtgacgtgcataaaatgtcacacctgaagtaatgaagggtctagagaaacccatacattctaaaacagtatagataaaccaaactggaattaaaaaaaacattaccttgctgagagcagcagccggtgagaccctaacccagcagcactagaggaattagagacacacacacagaaatatagaggtgccaagtgggaaatcaggggtctcacagccttcagagctgagagtcctgaacaaatatttactcaggtatttattaacagcaagccagttattagcattgtttctatagatattaaattaactaaaagtatcccttatgggaaacgaagggatgggccacattaaaggaatatgttgggctagttaactgaaacaggagcatgtccttaaggtacagatcgctcatgctattgtttgtgacttaagaatgcctttaagtggttttctgccctgggtgggccagatgttccttgccctcattccagcaaacccaccaccttccagcgtgggcgttatggccattatgaacatgttacagtgctgcacagattttgtttatggtcagttttggggccagtttatggccagattttgggggggtggcctgttcccaacatgtctcccttctttgatttgcaaatcaataaaagcaaaggcagctgcgtcatggtgagctacttctcacaggagtcaggatctacatctgcagactatacaaagacaaatgacacagattaaaagcacaatcatcataaaaattacagagcttcccagtgtttttatccattttaatgggttaatagctgctaatctgtctgcagctcctttcagccctccagttcttggcattaaggccaggcgtgcctgggatgctttaaatatttgttcttttaattttgcaatatccaaaaacaagtttgtagagtgtccttttagatgcttttttattcttcccccaattttgatcttattaagagctattaatagtttccacaaatccttaatgtttagctcctacagcaggccatatcatttgaggttgaggtgccactatactgccatggttccatataataataactcttgctgtacttcttattatgtctaccatctgaccattttgttcagatcagctgaacatagtgtggccttggcacacagactgagaggtgcaatttatgctaaatatccccttaggggatcaatcaataatgattccataggaatcattgtgcagcacctctgtctgttctgcaatgcaatcttcctaaacaagtacattcattttttctggccaggttcaattttgtttacaaataggttttttagggcggtatacctcaattataggagcagatttattatggtaaatccagagatcagaaagcatgtgtaactgtgtcatagagtgattatatccaggcattattgccagccaagattgataaatatgcccaataagtatgattgttccctgtgtcagcccttactgaaggaatactcatggcagtggtgatcatcactatcatagctaccattaaattactcattgtgactggttgttccactttcctcaggttttcttttatcatcagtgacagcttcttgatctgtccccaggtgggtggcagagtttgactggtattgctcatgacagttgaagtcctcctcagcatcagtatcaacctggctgcaatggggggggtggtcctcgggatcctcctggaatctcttccttggcatctggcttatgataaggtttcaggtattttgatggtacctaaatcagctgttgaatttggcctggagaaacagaaggataacctctaccccaagttattattttacctgtttcccaactttttgttattgaatctctccaccaaatcagttgttctgctcctgtctttgcagctggtttctgtagatgctgttcagctcctgataacatctggcctttgggcaggctcaaaaaatttaaagttaataatgctagattcaattgtgtatggactgtcctgtaatccctatttctccctcttttttgtttttgtcatcagttgtttatctgtatgatatcataactgagcattttcaattaactctgtggaatgaaccatgtatgatgaatcagaaatcacattaataggcataacaaaagcagccaatatctcgattacagctacaagctttgctttttatagggcatctgaataactttacttttttgagccagaataagaagctttactattactagacccatctgtgaaacaatgaaaacacttagcaggctgcaggttgtttactgcaggaattatacatgcaaaccgcttacaggcttgctcagctaaagggatagtaaagaactgaactgatggctcttaagtcagttaacattctccatttacctgattttttcttaattacaaaaactggagaattccaaggggaaaattttggagctgtgtgcccattttctaattgttcagtaactcatttctccaaaacctccagtttctcttaacttagtggctactgttctatccaaattggcttatctgttaaccattttaagggtataggttctggaggcttaacaatggccaccagcaagaatgatatcctaatctttgatgggatctttgtctttccacttgaagcagttctttcaaatcttgcaaatttttttctagtcctatgccagggacataccccatttcatgcattgtatgttgactttgagggctatataattgttctggaattagaacttgtgctccccattgttctaataaatctctcccacatacatttataggtacagaagttataattggttgaatagtcccacgttgtccattgggcccttcacagtgcaaaatataactactttgatatacttcaggggctttaccaactccaactatgttaaatttagtgggttgaattggtcacgcggacagccagtgctgtagagaaatgattgaaatgtccactgctgtatctaccaaacctttaaatttctttccctgaatggttatttcacaggtaggacgtttatcagtgattttatttacacaataaactgctttgcgttgtttatttgtgcttccaaatcctcctgttcatttaatttcactttttctcattcccacatatagcacaatcaggagctgtgctatgtgctctcctggctctgctttccagggaacaaaagtagatataacaatgtgaatttccccattgtaatctgaatcaatgactcccgtatgtatttgtatcccttttaaacttagacctttctaaaagtaatcctattgtccctgctggcaagggtacacagaatcctgttgggaccttttgcgggggttccccaggcagaaggctcacagcttttgtgcagcataaatctactgcggcactaccagctgtggtgggtgacagacattgcacaggggtgagggaatggcctgagctggaaatgccccagtttagaatgaggcccaggatgggcccctcatggcatttcctcaaatcaggttcccatctttatcaaacttagagtgacactgattagcccaatgttttccttttttacattttggacatatttcagactagcagttttcttttttcccctatctggtggcctgatttgctgattatttctccattcttttttagtatgaatagcttgtttaaattctttgagtaatttaaaaagaaaaagctcaaatgtagctataatatttccctgttgaactagggagtgtattctaacagggaactgccaagcctctaaatcaccctctcgtctagcttgctgaatttctccctgaatagaactaaaagcggtcacttgaggcgctgctcagtcactggggcaactactttttacccagtgtcctccagaaaagaaagatctggagggtcattttcttcaaaataataatgagggggtgcagaatggtagggatgaacctctccctcctttgccgctttagctttagctggtaaataaacatgctttgtaacctcttctgttacttcgttatactctccttcctcctccacatcagtgtgaaaaagttccaaggtggaatgaaccagaccccacacttttcccattggtaccctgatgcttctgagctccccttcttactcaccacagggattgcttaattccacgttctccaaccatcgctccagcaatccttcaacctggattcgagcccccacgatggacaccacttgccaagaccagctcaattggggagaccctaacccagcagcactagagcaattaaagacacacacacagaaatatagaggtgtcaagtgggaaatcaggggtttctcagccttcagagctgagagccccgaacagagatttactcacatatttattaacagcaaaccagtcattagcattgtttctatagatgttaaattaactaaaagtatcccttatgggaaacaaagggatgggccaaattaaaggaataggttgggctagttaactacagcaggagcatgtccttaaggtacagatcactcatgctattgtttgtggcttaagactgcctttaagcagttttccaccctgggcgggccaggtgttccttgccctcattccggtaaacccacaaacttccagcgtgggcattatggccatcatgaacatgtcacagtgctgcagagattttgtttatggccagttttgtggccagtttatggccagattttggggggcctgttcccaacacccatcatataccagcagtgcacttagagaaatgcaccacctgaatgagctgtgtaacactaggaaagcacatctttagttggaacattactggtttcacttaaaaccaagtatcagacacattatatacacactttgttttctgtttttcatttctaatattcgtatattagcattaaagagagaaatacaatttgagtgcttgtcatcagtgaagaaagtgattggcgtaattgaaaagatgaaaagagcagacattctgagtgtcctcaatcgatcttattgatttttaaaggattctagggcttgaatgtctcaaactagtccaaaaaaagccaacagcaggacccatacaactataaatctcactagatacatcccctattccatgaacatgagaggagatgaacattatcagccttgcccaatttctcagcttacatttatttgggggtcaatccaataccgttatatgaattctttggaaattggaatatttgagcaaaaatgtttactttttgcacttgaaaatacaaaaagatatagacatagagtgcatctttattagagaataccgaaaatcccttcaagtccaagttttgaaatccccagttgactgtttggcagaatggctcattgtcaggtagaactcttttctagggcccaaactacattgcttagatacaatgcaaagagacatgggccaaccccacctttccagctcattcgttatcagcaaaaagcttcggcctgggctccagttatggttatagttggcttcacaggtgtgcgaactgtcatctgggtgatcacagggtgatgacagggctgctgcatgttgctctggaggtttttcactgcacagtgaactgcctgatcacagcagccttagacaaaactggataacatagttcttaatgttttcttcctcattgagcatcccctgatctgagaggctgtgaggcaagtttttacaagacaaagatattagctgagaggatcaagtagaacaaatgcattgttgctgaacaccaggggtttggcctaggtgtggttgctcactgcacagaaagccagtcactaagacgagtattgccagggaagaagagatttattgtggatgctgtcagtctaaccgtcaaatccgtctctctcccaactaaagttaggagtttatatagacaggaattaaggggagtaaggaatatgatcaacaggcagcaggtggttagatgagaggtctagcatctcattgtaaccacctgtgggaaaacaggaacgggagagaaggaagaggagtcaactggcaacagctctccttgtccagttgtggtgatctgtaaagtttcagttccatgaaactatgtgggagtcctaatgatcagtttattgagaaagaaactcagatgacaaatgttaaatttctcaacctttaagacttggaggtcaatcctatactttggatatttttgcctgcttaaatctgatgttgcattgtaattcccagggctggaggtaggtcctggtgggaggtgatcatggggatggaaccctcatatggcttagtgctgtcttcctgatactgaattctcccaagatctggtcatctaaaagaatctggcacattccccaactccctctctcttgctcctgctttgccttctgctatgactgaaagttgaggcttcaccagaagccgagtagatgccagcaccatgcttcctgcaaagcctgtagaacctgagccaattaaacttctttcctttataacctctttactttatattacccagtctcaggtatttctttacagcaatgcaagaatggtttgacagtcaatttctatgtttattcccctcacaaaaggcctccataaacatcaactgcataggaaaattgagctggtttcaagatcaaaaatttggcccatattaatagtggttgaaactttatgtttacaattattacttctgttcattttaccatctcctcttcctccatgcagcaggggcatgttgcaaatcacacactccaaaaaattaaacacaggacattccaaaaattagcattggtattgaaaacactcccccaaatcaggcttatttgccattcgtattttttctgtagtgaaattttcataccaatctttcaccaattttctttttgggatttttcttctattcttatccaaagctgttttacaagtacttttttcagtccataactcacctttccatttccttaattgtgtgctttaagaacacaagttttgaatttaacaaaatctaatttatcaaagtttaaagtgagtacatcgtttttattactttaagtgcattaaatttgtgtatattccatatttgtattgtccatagagaaatcatcacctaactgaaacctacaaaaattttctcagtttttcttctataagttttaactttgagctcttgtatttagatctatgatgagttgaggccttatatatgctttggggagtcaaagttaacaccacattttgaagatgtgtctttccccttggatttcattggcacatttgctgaaaatgtcccaagcacctcatggggtatggctgtggttctggactcatgtattcacaattgttttgaatattcacataaatttataatccactgtcaaattttaattcaggtggtgtttaattaatagaacaatttgaggaaaactgacatctcaaaaatagttttcttgcctattttggccctatttctgccatacacattttggaaaactttttccagtactaagaataaatattggaagctttattgaaattgtatcaaatttacagaaacatttaaagaaaacatattaataatggtcttcctaatcattgaaatttttactttatttttaatttttttgggtacatactaggtgtatacatctatggggtacatgatatattgatacaggtttgcaatgtctaataatcacatcagggtaaatgggatatccataacctcaagcatttatcctttgtgttacaaacaattcaattataccttaaaaatgtacaattattattgactgtagtaaccttgttgtgctatcaaatactaggtcttagtcattctacctttttgtgcccattaacattccccaattccccctcatcatgcccccactacctttcccagcctctggtaaacattcttctactctatctctagaagttcagttgttttcatctttagctccaataaataagtcagaacatgtgatgtctgtcttgctgtgcctggcttatttcacttaatgatctgtagttccatctataatgttgcaaatgacaggatctcattcttttttatggctgaatagtactccgttgtgtatacgtaccatattttatttatccattcatctgctgatggacacttggattgcttccaaatcttggctattgcgagtagtgctacagtaaacatggtgcagatttatcttcaatatactgatttcctttctttggggtatatacctaccagtggaattgctggattgtatggtaactctatttttagtttttgaggtacctacaaactgttctccatagtggttgtactaatatacacttccacagtgcacgagggttcccttttctccacatcctcttcagcatttgttgttacctgtcttttggacagaagatattttaactggggtgagatgatatctcattgtagttttgatttgcatttctctaatggatcaatgatgttgagtacattttcatatgcctgtttgccatttgtatgtcttctttcgagaaatgcctattcagatttttgtccagttttcagattaattttttttctatagaattgttatagttcctgatatagttatagttacagctcctgatatagctagtgatatagtttggatatttgtccctgcccaaatctcattttgagatgtaatcctcagcattaaaggtgggtcttggtggaaggtattttcgtcaagggggaggatccctcattaattgatgctgtcctttcatcaacgcccatatttctgccatatgcattttggaaaagtttttccagtgttaagaataaatattgggagttttattgaaatattaaatttatagaaactgctattattttaataatgagtcttcaaacattgaaattatttttaaatttttgtgggtacaaataggtgtatatgtttatgggggtacatgagatattttgatacagtcatgaaatgtatatgaacacatcagggtaaatggggtatccctgacctcaagcaaccctcacaagacctgagtactcacaagatctggttaagtgtgtggcacctccctccccctctctttgcccttgctcctgccatgtgagatacttattccccttttgccttccacaatggttggaagcttcctgacgcctccctacaagctgatcagatgttagcaccatgcttcctgtacagcctgcaaaactgtgagccaattaaacctcttctttataaattacccagtctcacgtatttctttatagtacttcaagaatggcctaatacagatggatagtttgcaaatattctttcccattctatgggttgtctcttcactttgttgtttcctttgcaatacagatttttaacttgatgtgatcccacttgtccatttttgctttggttgcctgtttgtcaggtattacacaaaaaatctttgcccactccaatgtcctggagagattccccaatgttttattttagctgtttcatagtttgaggtcttagatttaactttttaattaattttgatttttgtatatgttaagagataggggtctagtttcattcttctgcatacggatatccagctttcccagcaccagttattaaagacactatctttaccccaatgtatgttcttcataactttgtcaaaagtgagttcactgtagatgtatgaatttgtttctgggttgtctattctgttcctatgtgtctgtttttatgccagtatcatgctgttttggttactgtagctctgtagaataatttgaagtcaggtaatatgatccctccagtttgattccttttgctcaggataactctgactattctaggtcttttgtggtttccatataaattttaggattgtgttttctatttctttgaagaatgttaaagttttctggatattgcacagtttgtccattaacttgctgagcaacatcttttttttttcttttttcctgagacagggtctcactctgtcttccaggctggagtgcagtggcatgatcacagctcgatgcagtctcaatctcccaggctcaagtgatcctcccacctctctgcctcctgagtatctcggatgacaggtgcatgccaccacgcctggctaatttttatattttttgtagagacagttttgccatgttgcctgggctggtctcaaactcctgggctcaagcaacacacccacctcgacctcctaacatgctagaattacaaacatgagccactgagcccagccagagtattttctttctgttaggtacatgaaatgattcaggctcatcttctttttctcccaatctccgactaggaatcatccctggtccccttttttgtggatagtatttaggaaataataacttggcagttggtgtgtttactgttactgagctgtgactgcatttatgtcctctcggtagaatgaatcacaaaatatatgtatatgggcacacccaacaatttctctattgttcctatgtatttaaaagatatgagttctattctaatcccacactgcaggttttctagctctcctcattcctatttctacaaataccttctctaacagggagaaaccttgccatcatcattctcaacatatttgctcagtggtaccaatctcttaacaatgctgcccatctcctccccctgtcccttccacacctcaccctcagccctcttggtgccagcagacacatagccacaactcctctcatcccacaatgcaggtctaactcctccactctgggaagggaaggcaaaagagacacataaaaactcaaagaggggaatcaaaagaaagaggaagggaaggccacattgattttttaaaaaataataaatcatcttttgattgccctaataaacatctcttggtgatgatacagtttatggatatgactagactttttttttcaattttaggattttgcatctaaatctatgagactttggtctatagctttatgttttttgtttgtttgtttgttttattggttttggtatcaaggttgcactggcctgaaaaactgaattggaaaagttccaacttttttcttctagaagagtttataaaagcctggtatgctttatttattaaatatttggaataacttcagtggagccatctgtcctagagttttctttctaagcaagtttttgaatattccactcagatattgtttgcagttgtgacaaggtacaatgaatctctggtatgaccttgtttccagggcttttactgatggcatgttcatgaaaggaccaacccactggcacttcctaaggtctaatcatttctcctccatattgcaaaatgcaaaacaaaacaaaaatcctacttgttttcttctcaaattagcttttcagcctcctgccctatgcagcatgagatatctggaaatttcttgagaaattatgtgtttgaagcccctaatgtatccatttttttttaattgcagtcttgattgttctcctggtttctggtcccccccatgccttcccctgacccccagggtatggccctctgcctgaaccaagttcagtattcaggttcttccctatagccagaagtggaaagggtccccagagcaaagagctgcattctgtgcatgtgctttctgggatttaccactctctagaattttgctcctttagttctctttgcttctatagcaataagttgcatttaaatattttttgtaattttatagttgtcctcaatcagtccattctgctgccgactactataccttacccaatagcaaaatctattttttttttaaagtgtctgtcactcaggctggagtgcagtggcatgatctcagctcaatgaaacctccaactcccaggttcaagtgatcctcccacctcagcctctctagtagccgggactacagatgtgcgcaatcatgcctggctaatttttgtatttttagtagagacagggtttcatcatgttggccaggctggtctggaactcctgacctcaggtcttgcccacctcaacctcccaaagtactgggattacaggtgcaagccaccatgctcagcctatttgtgctttttcaaagccccatatttaagttatatctctatatacattttaaaaagttatatcacctatgaaaaatgtatttcactttggagagaaatagagttgggtacaataagtcactcacagcagaatgtcctggcttatgtgttggacatctgctagggcagaaaccaccagaaatctggacccactctcttctactaatcctcttaagctgcatacaaggcaagttgacttgcccccttgatccaccattctgagacgggtcacccaaaattagtctgccccaggattattcaaaaatcctgctggtgggctcctgtcctatggccccagattaagggtctctttcttcctggacatacaaaagcactcttgcttatggttccctttgctaaaaactcttcccttattttacatatggctaagcaatacatctttgacctagttatagtcattggctccagcgtggcatcttttcaagtgtcagaaaacagcagtcttgacaatgaactgaactggatataagcaaagtaaaatgctatttctcaataaaaacctttttttgcgtggtggctcacacctgtaatcccagcactttaggaggccgaggcgggcagatcacgacgtcaggagatcgagaccatggtgaaaccctgtctccactaaaaatacaaaaaattagtcaggtgtggtggcaggcgcctgtagtcccagctacttgggaggctgaggaaggagaatggtatgaacccaggaggcagagcttgcagtgagccgagatcatgccactgcattccagcctgggtggcagagcgagactctgtctcaaaaaaaaaaaaaaaaaaaaaaaagaaaaccttttctctacatgttcttaaattgctagatatcctgcaattcaacacctctggtctatattaaatttagattttaacctaaagtgtccacacattggatacagttaaaaatactttctcactatctgatgttcactaagaaggtacttcttattacatatactctataaaatataacctcatagtaaatgctttcctatagtttgtgcattttctgtggcctcttgacttcacacagaatgattttccacattcattacatccatagggtttctgtcttatatgagttctgtggtgaacaattagggcccacttctggtgaaaggttttcccacattcattacacccaaaaagtttctcccgtgtgtcttctcagatattctgtgaaactgtagtagtagcaaaaaaatgcatcccttctcaacttacggatgttgagccaggtttcaccctgtgtgaactctctgatgtttactgaggtgtggcattgagcaaaatgtttcctatattcattcaccaataagtgtttttcacttttagttcttaaacataatctatggcccaaatcccagaataatgttttcctgcattccatatcttcatattgttttttccctctttaagttctcttctctactgtgagaactgacttcagggcaaaggtgttctcattatcattatattaacagatttctctcaccctttatgttctctgctctacaaagttctgacttcacccagagtaatttccctcacttactacatttatagggtttcacctcaagtgtgttctgtgatgtacagttagttttgacttaataataattttccacaaacattacattcatagggtttctcccctgtgtatgttctatgatgtgcaatgagttttgacttcacacagaatgattttccacattcattacatccatagggtttctgtcttatatgagttctctggtgaacaattagggccaacttctgatggaaggttttcccacattcattacatccaaaaggtttctcccctgtgtgtcttctcagatgttctgtgaaactgtagtagcagcagaaaaattttccacattgaatacatgcataagatttcccatctgtgtgttcttagatgtttagtaagggttgacttctcggagaatgacttcccacattcattacattcataaggtttttctcctgtgtgaattctctgatgtttaatgaggtcggattttctgagaaaggtgttgccacatgcatagcattcatagggcttctcccctgtgtgttttctgatgcacagttagaactgacttaaacgaggttttcccacattcatgacattcatgatttctccccacgtgtgttctctgattttgagtaagggatgacttttcactgaaggatttctccattcatgacatctgtaaggtctctcccctgtgtgaattctttgatttctaatgaggtctgaattcttatagaaggtcttcccacatccgtgacattcatagggttttccctgtgtgtgttctctgatgtcttgtgtgggctgacttctgggtgaaggtttttccacattcatgacattcataaggtttttcccctggatgtgttctctgttgtaaatgaagggctaatttttcactgaaaaaggttccacattcattatattcaataatattgctaattgagtgggttctctgaattagagtgggatttaaattctggctgaatgggtaaacattctgatgttcaaagagaatggattcctcaaagatactttctccacattcattacattcatagtggttctctcttggatgtgtttgctgatgagtaataaaaaatgacatataacaggttttcccatgttcagtatatttgcatgttttctgtcctgtgtaagctctcttatgtacaaggaagagtgaattctcagggaaagctttcccacattcattgtattcaaaaggttgctcccaatttttaatcttctgatgccaaatgaggtcttcattcagccagaagctgttcccattgttattatattcagaaggttcctcttcaaaatgaattatttcatgctttcatcacagaaacattttccacctttgttaaactcattgaacttcattcttgaatagtttctactggtattaattaattctgaaatacagagtgacaagaaagattagttgacaaggatatgtaagagaactgaagttagcattatgtttgaaggctcagtttaagccattatctcctcacacctacattatgacaacaatgtgcacacttccagtcttatacctcttttcaactcaacacagcagcaacaaatcaaatttctaaaagttctaattcatagatagtcctataatccaggctccaattgtgtgtgttgttgttgtttttgagacagagtcttcctctgtcacccaggctggagtgtagtggcatgatctcagctctctgcaatctccgcttcctgggttcaagcgattctcatgcctcaacctcccaagtagctgggactacaggcatgcaccaccatgctcagctagtttttatgtttttagtagagacaggattttgcaatgttaaccaggctggtctcaaactcctggcctcaagcaattcacccacattggccttcaaaagggctaggattacagacatgagccactgcatctggcttaattgtttttctagctctgattcactaggaataaaagtatgcaacaataagagtgaaatcaatgagtgaacaagtcatcgttgccacaggatcaggcttatggttctattccggctatgggatttgccctttattccatcaactgtactatattatactgagtccaatgttccaagaacaaacactttttttttaacaaggtatcactgaagtagacatatctttacgtttagattcagattagaaccaagccattcttttacaagtctataatgaatgtaattcactctaggtaagttcatctgtttgtccctcataaattgctcattcccatcataattttatactgatttttttttcattgtcagcttacagtctaacaatgtttttaaaaagttgccttcccaaattttcccaccacttccagattcatttactaaaaaacatgaaaggaccatttgtataattcatttaagcacaaacatcagctggattgctataacaatattctttgttaaacactgaattttaaaatatttcatgcagttctgttttcgttcaccaactatgttcctggcagccattactttacctatgattttctctcagtgccctacatagatatttatatcatggtacctaataaataatgtttatcagaattacccagagagcattttcaaacacaaattttttcaggcttcacgctgaaatcattactgtttgaatgtttaattttaattttaaatgctttttatattttagagacagaatcttgctctgtcacccaggctgcagtgcaatggcacaaacacagctcactgcagcctcttcctgggttaaagcaagactctcagctcagctccccagtagctgagatcacaaaaatcagccaggcatgggaccgcatgtgtgtgccaccatgcctggctaattttttaagttttgatagagatagggtctccccgtgttgaccaagctggtctcaaattcctgggctcaagagattctcccacctcagcctcccaaattgctgggattacaggcatgaaccactgggcccaggctattttaaaataattctgtaaaaaaatgtgaatatggtagaatgctaacgaatgagcaactcaaaaaagcatgtatagaaaaatatatttaatattttatagaaggagggatgctcttgaatgggaagaccacacgagggagctttccaggggtgctgaaaaacactctatatattcatctcaatgatggatacatgagtgtctcatatatatatatacacacatatatatttaattttattaagctgtgacttaactatataatttatatcacaattaaaaaaaaagatgtgtgtatggaagtgatactgggagatgctgggtgattaagagccactggatatttgggtcatgtcaacatgttacttccaaaggtctagagcctctaaaatatgattcctgaagaacatttcaatggtcttattatctgaacttaccctttgtgatctgcctacctttaaattccatctggcactaactcacccagatgactctggcttcgaaatttttcctctaatatccatggctccttgcctgtctccaatttgaggatcacttctggtttaggaatgcaataccctgtgaatgatgcaataccctgtgaatgagaattatattacttctgacaaactgggtgggtttccctgaaggaggaagacagtataccccaaacagtacacacacacacacacacacacacacacctcatttaatcctgtcgtggggcagaggaaaatattctttctggtatccaaaagggatacattgtctctgacctctaaatttcaaagctaaatgttatattttacaaaatttccacaagtttctatcgataagaaaggacatgcattctggccttctacatgggaaacaattcctacctacctactgagacaaggtggctgtagttctccagcatcacattcctctacagggtcctctgagcagggtccagatgatgccactcctcttgagtgaagcccatagtcacatccctaaatgacactgatccctggaaaatcacagttctgctcagtctgatgcaataagaatcagctgatgtgagacaagatgtttagggactaattcttacaatttttgttgttgaaaattaaatagaaaatgttataaagggcctccatgatatatgttgttttatgttacacattgtgggtaaaagatcatagcagaaatatcctgttggtgaattaattacttaatgcaaaagtatttagtacctacatgtgcctagagctttcttagtttctgagtattccaatttgaatacaagagtcttccttacaagagaggaacataccttctcataaggaaacatacatacagagacatatctaccacaggacttaaaggactcacaccacagatatgtgcaacacagatggatcataaaagtgttctgggcaaattcatgtgagagtgtgtcaacatattagacttcactgaagtgataaaactttagttcctttgcaaacatataacaaaaacttaagaaaacgttaaaaacctgaaaaaatatgtggcaagtcaatggaattgcttaacaggataacagcatgtcttacctgtgatgagataaaggttgcagaggcatgggagatgagggagactaggaaatacttttggctttaatcctgttagtgttctccaaatatttatcactcttctaatccataaaaatgtttagcaactactagtttagtttatatttataaagtaaataaaatacaatctacatataaggaaagcttaattttgttttcattttttagataaaaatataaataggcatgctgatagtttcctcccatgccctaaaggactggcagtatatgacataaacacaataatcttgcacacttcctttaggccataggctccctgctctcccaactccaagtcattgatgcaaatagcagaagttgatggtgaactgaaaatacacacctgaatccctgtaacataattcagttttcactcaggaagcaatgccaccaaagtacagtggagactgtgctggagagcagcgttagaggtagattgtctatattacggggcagcagtggagatgtggaagagggaattcactaagcaaaggaagagaagaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagttcaagaccagcctggccaacatggtgaaaccccgtctctactaaaaatacaaaaaatagccatgcatggcagtggatgcctgtaatcccagctactcaggaggctgaggcaggagaacctcttgaatccgggaggtggaggttgcagtgagccaagatcgtaccactgaactccagcctgggtaacagggtgagactccatctcaaaaatatatatatgtcagagaagaaaaaaacagcgttccaaaatcaatgttaatatttgcctaactgtgaaaacaaaaaaaatactctgtgaacactactagaaaataaaataggccaggtgtggtggctcacacctgtaatcccagccctttggtaggccaaggcgggaggctcacgaggttaggagttcaagaccagcctggtcaacatggtgaaaccccttctttactaaaaatacaaaaattagccaggcgtgctggcaggtacctgtaatcccagctactcaggaggctaagacaggagaatcacttgaaaatccaggaggcagatgttgcagtgagccaagatcgcaccactgtactccagcctgggcaaaaagagtgaaactctgtcaaaaaaaaaagaaaaaagaaaaagaaaaagaaagaaagaaagaatacaaaatggatgtaaaatgcagaattgtacaaatctaaatgtataaaattgcacaaattatcataaaataaaaacttgaagaagagttaataatagtttgtaaaatataaataaatctaggagataaattccattctacaatgaattctagaagaaaaaaaagctaaagagagacttttgggggggggaatgagggcaatcaagagcactgtgtacgttatagcccatttatgcctgaggttacaattttattaatttttgcaatcagaccttgaaatgaccttaagcagtaagatataaataacccccacaggcttagcgttccaataatggaacactaggtataaatgggttagggaattcagaatggcaagcacaaacccaggacaggagaagcttggcaaagacctgaaaagaccctaaggttttacttctggctaatctctatgctcggttcaagcaagtagtgaagactaagatgaagttctttttattattattattattattattattatactttaagtttagggaacatgtgcacaatgtgcagattagttacatatgtatacatgtgccatgctggtgcactgcacccactaactcatcatctagcattaggtatatctcccaatgctatccctcaaccctccccccaacccacaacaggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcattattttttatggctgcatagtattccatggtgtatatgggccacattttcttaatgcagtctatcattgttggacatttgggttggttccaagtctttgctattgtgaataatgccgcaataaacatacgtgtgcatgtgtctttatagcagcatgatttataatccttttggtatatacccagtaatgggatggctgggtcaaatggtatttctagttgtagatccctgaggaattgccacactgacttccacaatggttgaactagtttacagtcccaccaacaatataaaagtgttcctatttctccacatcctctccagcacctgtcgtttcctgactttttaatgattgccattctaactggtgtgagatggtaactcactgtggttttgatttgcatttctctgatggccactgatggtgagcattttttcatgtgttttttggctgcataaatgtcttcttttgagaagtgtctgttcatgtccttcacccacattttgatagggttgtttgttttttttcttgtaaatttgtttgagttcattgtagaatctggatattaaccctttgtcagataactaggttgcgaaaattttctcccattttgcaggttgcctgttcactctgatggtagtttcttttgctgtgcagaaactctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagcttactacatacggctagccagttttcccagcaccatttattaaatagggaatcctttccccattgcttatttttctcaggtttttcaaagatcagatagttgtagatatgcagcgatattcctgagagctctgttctgttccgttgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtttttccaattctgtgaagaaagtcattggtagcttgatggggatggcattgaatctgtaaattaccttgggcagtatggccattttcatgatattgattcttcctacccatgagcatggaatgttcttccatttgtttgtatcctgttttatttcactgagcagtggtttgtagttctccttgaagaggtccttcacatcccttgtaagttggattcctaggtattttgttctctttgaagcaattgtgaatgggagttcactcatgatttggctctctgtttgtctgttgttgatgtataagaatgcttgtgatttttgtacattgattttgtatcctgagactttgctgaagttgcttatcagcttaagattttgggctgcgacgatcgggttttctggatatacaatcatgtcatctgcaaacagggacaatttgacttcctcttttcctaattgaatacactttatttccttctcctgcctaattgccctggccagaacttccaacactatgttgaataggagtggtgagagagggcatccttgtcttgtgctgattttcaaagggaatgcttccagtttttgcccattcagtatgatattggctgtgggtttgtcatagatagctcttattattttgagatatgttccatcaatacctaatttattgagagtttttagcatgaagcattgttgaatttcgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaagtgagttagggaggattccctctttttctattgattggaatagtttcagaaggaatggtaacagttcttccttgtacccctggtagaattcagctgtgagtccacctggtcctggactctttttggttggtaaggtattaattattgccgcaatttcagctcgttattggcctattcagagattcaacttcttcctggtttagtcttgggagggtgtatgtgtagaggaatttatccatttcttctagattttctagtttatttgcgtagaggtgtttgtagtattctctgatggtagtttgtatttctgtgggattggtggtgatatcccctttatcattttttattgcatctatttgattcttctctctttttttctttattagtcttgctagcggtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgctttcctagttcttttaattgtgatgttagggtgtcaattttggatctttcctgctttctcttgtgggcatgtagtgctataaatttccctctacacactgctttgaatgcatcccagagattctggtatgttgtgtctttgttctcattggtttcaaagaacatctttctttctgccttcattttgttatgtacccagtaatcattcaggggcaggttgttcagtttccatgtagttgagcggttttgagtgggattcttaaccctgagttctagtttgattgcactgtggtctgagagatagtctgttataatttctgttcttttacgcttgctgaggagagctttacttccaagtatgtggtcaattttggaataggtgtggtgtggtgctgaaaaaaatgtatattctgttgatttggggtggagagttctgtagatgtgtattaggtccacttggtgcagagctgagttcaattcctgggtatccttgttgactttctgtctcgttgatctgtctaatgttgacagtggggtgttaaagtctcccattattaatgtttgggagtctaagtctctttgtaggtcaatcaggacttgctttatgaatctgggtgctcctgtattgggtgcatatatatttaggatagttagctcttcttgttgaattgatccctttaccattatgtaatggccttctttgtctcttttgatctttgttggtttaaagtctgtttgatccgagactaggattgcaacccgtctttttttgcttttcatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcttagtctcaatggtctttacattttggcatgattttgcagtggctggtaccggttgttcctttccatgtttagcacttccttcaggagctcttttagggcaggcctggtggtgacaaaatctctgagcatttgcttgtctgtaaagtattttatttctccttcacttatgaagtttagtttggctggatatgaaattctgggttgaaaattattttctttaagaatgttgaatattggcccccactctcttctagcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccattgctgatacgctttcttccagttgatcgcatcggctcctgaggcttctgcattcttcacgtagttctccaggcttggtttccagctccatcagctcctttaagcacttctctgtattggttattctagttatacattcttcttaattttttaaaagttttcaacttctttgcctttggtttgaatgtcctcccatagcttggagtaatttgatcgtgtgaagccttcttctctcagctcgtcaaagtcattctccgtccagctttgttccattgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagtttttcttctaacagacaggaccctcatctgcaggtctgttggagtacctggccgtgtgaggtgtcagtctgcccctgctggggggtgcctcccagttaggctgctcaggggtcagggacccacttgaggaggcagtctgcccgttctcagatctccagctgcatgctgggagaaccactgctctcttcaaagctgtcagacagggacatttaagtctgcagatgttactgctgtctttttgtctgtgccctgccccagaggtgaagcctacagaggcaggcaggcctccttgagctgtggtgggctccacccagttagagcttcccagctgctttgtttacctaagcaagcctgggaaatggtgggcacccctcccccagcctcgctgccaccttgcagtttgatctcagaccgctgtgctagcaatcagtgagactccgtgggcataggaccctccgagccaggcgtgggatacagtctcctggtgctcagtgttttaagcccgtcggaaaagcgcagtattcggttgggagtgacccgattttccaggtgccatctgccacccctttctttgactaggaaagggaactccctgaccccttgtgcttcccaagtgaggcaatgcctcgccctgcttcggctcacgcacggtgtatgcacccactgacctgagcccactgtctggcactccctagtgagatgaacccggtacctcagatggaaatgcagaaatcacccatcttctgccttgctcacactgggagctgtagaccggagctgttcctattcagccatcttggctcctcccctcagtccagttgactaagatgaagttctaaatggaccaggctaagtgcttaaaaagtgccccaggacagagccaatttgcaaataataagaaaggggttttgttgtatttttgttttagttttttgttttttctttttcttttcctttttcttttttgtttggtggtggttgtttgaaacctggccttccaggaaaaatgcctgttaaaacactacctaaacacaagctaaagagagagaattcagtgaccacacataagactgcaaaaaaaagtttgaaaaattcataaaaacaaatggatactgaagacttcagtaattaagaacagcaaagtctagagaagaatgagaaagtgatttctaaagttactaaattataatattaaaatacccagtttcaacaggaacaagaaaatcacaaagcatacaaagaaactggaagtgttgtccaatcaaaggaaaaatagaaattgacagatatatcccagaggcaaaccaaacataacacttcttaaacaaagactttaaatcaactgtcttaaatatgctcaaaagctaaaagaaaacatacgagcaccagagagaaccatgaaacaacttataaaccaaatatcaataaagagattgaaattataaaaaagcaccaaatagacattctaaaactaaaaagtaccataattgaaataatgaattcaccagaggagttcaacagcagatttgggaatgccaaaaataatctgtgaatttaagtataagactattgaaattatcaagtttgagaatcagagcaaaaaagaattaagaaaaataaatggaacccaaaggacctatgggacaccatcaagctgaccagcaaaaacattatgggaaatgtagaagaatacaagagagacaaggaaatagagtatttgccgaaaagccaaaattaaactccctaaatttggtgaaagacacaaatctacacatccaggaagcacaataaactcaaaataaactcaaatacatccaccaagtcatgttataagcaaacagtcagaaaaaaaaaatgacagagaatcaaatgcaaaggagaagcaatttgtcatatacaaaagaacctcaaaaagatcatcagcagaaaccttggaggttagaaggcactggattgatatattcaaagtgctgaaagaaaaagctgtcagctgagaattctatgcatgggaaacatgcctgtcaataatgaggacattcccagatgaacacaagctaagggagtatgtttttactagatctactctgcaaggaatgctaaagggaatcctttgggttgaaatgtgattcacaacaaacaagggaactgttaaaagattataagccaagttttcatctggatttggtcttaaaagagaaattaggattaaataaataagaaaaatggcagagattggcagagtggacaaatttcttcaaataatgcatacaaaaatgtaattagaatgaataagatcgagtatttgatagtacaacagggtgactatagtcaacaattttttttattatactttaagttctggggtacacttgcagaacatgcaggtttgttacataggtatacatgtgccatggtggtttgctgcacccatcaacccatcatctacataaggtatttctgctaatgttatctctcccctaccccaccaccctccaacaggccctggtgtgagatgttcccttccctgtgtccatgtgttctcactgtcccacttatgagtgagaacatgcaatgtttggttttctgttcttgtgttagtttgctgagaatgatggtttccaccatcatccatgtcccagcaaaggacatgaactcatccttttttatggctgcatagtattccatggtgtatatgtaccacattttccttatccagtctatcattgatgggcatttaggttcattccaagtctttgctattgtgaatagtgccacaaaaaacatacatatgcaagtgtccttatagtagaatgatttataatcctttgggtatattcctagtaatgggattgctgggtcaaatggtatttctggttctagattcttgaggaatcaccacactgtcttccacaatggttgaaccaatttacactcccgccaacagtataaaatcgttcttatttctccacatcctctccagcatctgttgtttcctgactttttaatgctcgccattctaaatggtgggaggtggtatctcattgtggttttgatttgcatttctctaatgaccagcgatgatgagctttttttcgtatgtttgttggccacataaatgtcttcttttgagaagcgtctgttcatatccttcacccactttttgatggggttgtttttttcttgtaaatttgtttaagttctttgtagattctggatattaaacctatgtcagatggatagattgcaaaaattttatctcattctgtaggttacctgttcactctgatgatagtttcttttgctgtgcagaagctctttagtttaattagatcccatttgtcaattttggctcttgttgccattgcttttggtgttttagtcatgaagtctttgcccacgcctatgtcctcaatggtattgtctaggttttcttctagggtttttatggttttaggtcttacatttaagtctttaatccatcttgaattaatttttgtatacggtgtaaggagagggtccagtttcagttttctgcatatggctagccagttttcccaacaccatttattaaatagggaatcaatttcccattgcttgtttttgtcaggtctgccaaagatcagatggttgtagacgtgtggtgttatttctgaggcctctgttctattccattgatctatatatctgttttggtaccagtactatgctgttttggttactgtagcattgtagtatagtttgaagtcaggtagtgtgatgcctccagctttgttctttttgcttagaattgtcttggctatctgggctcttttttggttccatatgaaatttaaagtagttttttctaattctgtgaaggatgttaatggtaacttgatggggatagcattgaatctataaattactttgcagtatgcccattttcatgatactgattcttcctatccataagcatggaatgtttttccatttgtgtgtgtcctctcttatttccttgagcagtgttttgtagttctccttgaagaggtccttcacatcctgtgtaagctgtatttcaaggtatttaattttgtttgtagaaattgtgaatgggagttcactcatgatttggctctctgtttgtctattattggtgtataggaatggttgtgatttttgcacaatgattttgtatcctgagacttttctgaagttgcttatcagctttaggagattttgggctgatacgatggagttttctatatatacaatcatgtcatctgcaaacagagacaatttgacttcctcttttcctatctgaacaccctttatttctttctgttgcctgaatgccctggccagaacttccaatatcatgttgaataggagtggtaagagagggcatccttgtcttgtgctgattttcaaagggaatgcttccagtttttgcccattcagtatattggctgtgagtttgtcataaatagctcttattattttgagatacattccatcaatacctagtttttttgagagtttttagcatgaagcggtgtttaattttgtcaaaggccttttctgcacctattgagatattcatgtggtttttttcattggttctgtgtatgtgatggattatgtttattgatttgcctatattgaaccagccttgcatcccagggatgaagccaacttgattgtggtggataagctttttgatgtgctgctggatttggtttgacagtattttattgaggatttttgcatagatgttcttcagggatattggcctgaaattttctttttttgttgtgtccctgcaaggttttggtatcaggacgatgctggcctcataaaatgtgttagagaggattccctctttttctattacttggaatagtttcagagggaatggtatcagctcctctttgtacctctggtagtatctggctgtgaatccgtctggtcctagaccttttttggttggtaggctattactgcctcaatttcagaatttgttattggtctattcagggatttgacttcttcctgctttagacttgggagggtgtatgtgtccaagaatctatccatttcttctagattttctagtttatttgcatagaggtgtttatagtattatctgatggtagtttgtatttctgtgggatcagtagtgatagcccctttatcattttttattgcatctatttgattcttctctcttttcttctttattcttctggctattctattttgttgatcttttcaaaaaaccagctcctggattcattgattttttgaagggtttttcgtatctctatctccatcagttctgctctgatcttagttatttcctgtcttctgctagctttcgaatttgtttgctcttgcttctctagttcttttaattatgatgttagggtgtctattttacgtctttcctgctttctgttgtgggcatttagtgctaaaaatttccctctagacgctactttaaatgtgtcccagagattctggtacgttgtgtctttgttctcattggtttcaaataacttctttatttctgccttaatttcattatttacccagcagtcattcaggagcaggtagttcagttttcatgtaattgtgcagttttgagtgagattcttaatcctgatttctaatttgattgcactgtgttctgagagactgttaagatttccattcttttgcatttgctgaggagtgttttacttccaattatgtggtcaattttagaataaatatgttgtggtgctgagaataatatatattctgttgatttgggtgggagagttctgtagatgtgtcttaggtctgcttggtccagagctgagttaacattctgaatatccttgttaattttctgtcttgttgaactgtctaatattgagactgggctgttaaagtctcccactattattgtgtgggagtctaagtgtctttgtaggtctctaagaacttgctttatgaatctgggtgctcctgtattgagtgcatatatatttaggatagttagctcttcttgttgcattgatccctttaccattatgtaatgcccttctttgtctcttttgatcttcattgttttaaagcctgttttatcagagactaagattgtaacctctgttttttttgctttccatttgcttggtaaatattcctccatccctttattttgatgtgtgtctttgcacatgagatgggtctcctgaatacagcacactgatgggtgttgactctttatccaatttgccagtctgtgtcttttaattggggcatttagcccatttacatttaaggttaatattgttatatgtgaatttgatcctgtcattatgatgctagctggttattttgcccattagtagatgcaggtttttcatagtgtcaatggtctttacaatttggtatgttgttgcagtggctggtactggttgttccttttcacggttagtgcttccttcaggaactcttgtaaggcaggcctggtggtgacaaaatctctcagaatttgcttgtctgtaaaggattttatttctccttcgcttatgaagcttagtttggctggatatgaaattctgggttgaaaattcttttaagaatgttgaatattggcacccactcttttctggcttgtagggtttctgcagggagatctgctgttagtctgatgggcttccctttgtgggtgacctgacctttctctcttgctgcccttaaaattttttccttcatttcaaccttgctgaatctgatgattatgtgtcttggggttgctctcttcaaggagtatctttgtggtattctctgtatttcctgaatttgaatgttgacctctcttgctaggttgggaaagttctcctggataatatcctgaagggtgttttccaacttggttcaattctccccgtcactttcaggtacaccaatcaaacatagatttggtcttttcacatagttccatatttcttggaagctttgttcattcctttttgttcttttttctgtaatcttgtcttctcactttatttcattaatctgatcttcaatctcttatatcctttcttctgcttgattgagtcagctattgatacttgtgtatgcttcatgaagttctcgtgctgtgtttttcagctccatcaggtgatttatgttcttctctaaactggttattctagttagcaatacgtctaatcttttttcaatgttcttagcttccttgcattgggatagaacatgctcctttagcgtggagtagttagttattacctaccttctgaagcctacttctgtcaatttgtcaaactcattctccatccagttttcttcccttgctggcaaggagttgtgatcctttggaggagaataggcattctggtttttggaattttctgccttttgcactggtttctccccatcttcatggatttccttacctttggtgtttgatgttggtgaccttcagatggggtctctgagtggatgtcctttttgttgatgttgatgttattcctttctgtttgttagttttccttctaacagtcaggcccctctgctgcaagtctgctggagtttgctggagttccactccagaccctctttgcctgggtatcaccagcagaggctgccaaacagcaaagattgctgcctgttccttcctctggaagctttgtcccagagggtcacctgccagaggccagctggagctctcctgtatgaggtgtctgttggcccctactggaaggtgtctcccagtcaggagacatgggggtcagtgacccatttgaggaggcagtctgacctttagcagagcttgaacgctgtgctgggagatctgctgctctcttcagagccatcaggaagcaacctttaagtctgctgaaactgtgcccacagccgccccttcccccaggtgctctatcccagggagatggggcttttatctataagcccctgactggggatgctgccttttttgtcagagatgccctgcccagagaggaggaatctagagaggcagtctcagccttgctgagctgtggtgtgttccacccagttcaatcttccaggcagctttgtttacactgtgagggtaaaactgcctactcaagcctcagccatggcagatggccctcctcccaccaggttcgagtatcccaggttgagctcagactgctgggctggcagtgagaatttcaagccagtggatcttagcttgctgggctccgtgggggtaggacctgccgagccaggccactggctcctggcttcagccccctttccaggggagtgaatggttctgtctcactggtgttccaggcaccactggggtatgaaaaaaaagctcctgcagctagcttggtgtctgcccaaacggctgcccagttttgtgcttgaaacccaggccctggtggcataggcaccagagagaatctcctggtctgcaggttgtgaagagtgtgtgaaaagtgcagtatctgggccagagtgcaccattcctcatggctcagtccctaatggcttcccttggctaggagagggagttcccagacccattgcacttcctgggtgagacgacgccccatcctgcttcggctcaccctccatgggctgcactgactgtcccactggtcccagtgagatgacccaagtacctcagttgaaaatgcagaaatcacccgcattctgcgtcaatctctctgggagctgcagaccagagctgttcctatttggccatcttgacacaaatccccaaaataatttattgtacattttaaaataagagtataatttgattgtaacacaaagaaaggataagtgctgtagttgatggataccccactcactctgatgtgattttacacattgtaggcctatatcaaaatatctcatgtatataaatcacataaatatatatactcactatgtatccataaaaattataaacagaaaataaggggaacaaaagaaaaagatctaaccataagctgtctccaagaaactcatagtagatccaaagccagtaagctgaatgcgaaagggtgaagaaagatatttatgcaaataataaccaaaagagtgctgggtagctacactaatactagaaaaacaaaaaacaacaacaaaaaaaaacagactttaagtaaaaaactgttataagagacaaagaaggacattatacaactggaaaagtgttaataaaaaaaatcaattgcaaacatacgtagatcaaagaaaatagaaccaaacatataaagcaaacactgacagatttaaatgaagaaatgcagagttcggtaataatagttggacacttcattgctctgctttcattaatggatagaatatccagacagaagatcagtaagaaaacagagtatttgaataatggtataaaccaagtaggcctaagagaagtatgtggaatactctacctaccaatagcaaaatatgcattattctcaagtgcacaagaaacattgtacagggaagcccacagattagggcacaaaataaatctcagtaaatttaaaaagactgaaataataaaaatatatatatattttctgaccataataggataaagctagaaatcagtaatagaaaaaaatttttaacgtggatattaaagtttaatgatcaaataagaaagcacaaaggaaatttaaaaatacttagaaacaggtgaaaaagtaaagagactgtatcacaacttatgggatgcagccaagaatatgcctataaggagatttatagcaataaatgcctattttcaaaaagaaagaaatcaataactttacactttcagcaactagcaaagaaggatcaaactaaacccaaagctagcagaaggaaggatataatacatattacagcaaagataagtgaacagaaaatagaaaactacagagaaccaaaaaatccaaaagctgattccttaaatagaacaaaattcataagcttttagctagattgactaaagaaaaaaaattcaaaggactaaaatcagcaatgaaagtgacattacaaaaaaaaatgggttataagagaatactatgaacaactgtacactaataaattaagtaactcaatgaaatagacacatttcctagaagcacacacattactaaaactgactcaagaagaaacagaaaatctcaacatacttataacaagtaaagagatgtatcagtaattttttaaaaaactgcccaagggaaaaaaatccagcgtaagatggcttcactggtcaattctatcaaattaaagaagtaatactaatcttcctcaaacatttccaaaaattagaagggaatacttcctaactaattcccatgagttttataatgctggccagcattatcttgataccaaagccaaaaaaagacttcacaggaaaataaaattacaggctaatatcccttatgaatacagatgtaaaaaattataaaatactagcaaacaaaatttggcagcatattaaaaacattacatactatgaccaagttggatctatcccaggaatgcaagagtggttcaatataagaaaattaatcagtgtaagacaccacattaataaaacaaatgaataaacacgtgatcatatcaatgaggcagaaaaaaatacaaaacccaataccattcaaggataataaaagtcagaaaacagaggaaaggaagcaaagttcttcaacataataaagtgcatatataaaaaactcacaggtaacatactccatagtgaaagactgaaacatcccctctaagatcatgaacaggcaaagcatagtgctttcaccactgcaattcaacactgtattaaaagttctagccagagcaaataggcaagaaaaagaaataaaagacattcaaattgaaaggcagaagtaaaactactctatttgcagataacattatttagcaaataatccacaaaaaaactatgagctaacaaatggtttcggcgaagttgcagagtacaaaatcaacacataacaattaggttttctgtaaaaaaaaaaactccaacaatgaactatccaaaaggaaattcagaaaataatcccatttatgatagtatccagtagaataaaatacttaagtgttatggtctgaatgtttgtgcccttcacaacttcatatgttgaaatctaataccattgcaatagtatgaagaggcatggcctttaggaggtgattaggaagctctgccttccttcatgaatgagataagtgtccttataacttaatggacaaagtagtggcttcacaacctggagagacaggtttagatactgtgctgccaataagcagaaattttatttttgataagcttacataaagtaataatgtttttccaaaaataagactttgtcaaatggccccttttaacttctaaaattttttaatacatcaaatctgatttgaatatttaatatagcaagtatggataattccaggaagatggtgatctaagggatcaaaccagagctgaggagacaggtagcactggcaggtttaagagattagatacaggctgggcgcagtggctcatgcctgtaatcccaacactttgggaggccaaggcgggcagatcacctaaggttgggagttcgagaacagcctgaccaacatggagaaaccccgtctctactaaaaatacgaaagtatccagtcatggtggcacatgcctctaatcccagctacttcagaggctgaggtaggagaatcgcttgaacccagaaggtggaggttgcagtgagctgagatcatgccattgcactctggcctgggcaccaagagtgaaactccatctcaaaaaaaaaaaaaaaagattggatacaaacagggagaaggagcaaataaatattgtggataatgatatagcctggtttctcactattggagaaagaagttacaaagatggaaaacagaaaggctatggggttaagattgaaactgggaaatgtctatgtaaactcattgtttaaaaaatatgtatagacagaccaatacaaaaataagtgtacacatgtgtatttctgtgtatgtgtatgtacacatacatacatgtatttcctatctctgtcaattgagagggtctgaggcagtgacagcctctagcaatgagcacccagatcttggtttttaaattccatcctccactagaaagaacaatgtcctttggagaaatggctgatggcaaaggtagtgcaggaaaaggacaagatgggccaggcatatctgttgtgccacagagtaattactcaaaaattgatgtgggaagcaggctgaaaatggaataggtaattccaaaattccatcccaaactaaagcaacaattaagctggaaaaacaaaaaaaaccctctcagcatcaagcttttcagaattctccaatctaattaaaaacctagtaagcccagaacatttctggcgtggcttgctgatgcctgtgccaaagtggacagtatgcactttgttttcagagaactgtagttgtgtgttttgatctgtctatgcgggctctctgaagaagtggctcacaggcttgtctttgttttgcctgccttggaactttctcagggctagtcttccaggaagtgctagttgaaagcatttaaaggcaattatctggcctcagcagccagatgagaaaagcagcagatggactgataaaactgggagtggaaaaactgggaaggaaatacatgggggccggggtggggataaggggtttgaaaagctcctgcataaaccagggaattgaggtcatgtgcaaggccagggcaatatgcacgctcacaaaaaacctgagaggaacctaagctttcagtctggttgaccttcaggctcagtgtaagcaggaagtaaagctttacacagagatgtaaatggcctggcaaaccattacaagagcgccctaaaacagggcaaatatgcaaagaccagaatagttttttgttttgttttggctttgggcatttaaagaaatctctgtcagatcacaaactgaccactaaactaagggaacagaggtttctgtgaccatgtacaacaaagaactttacaaaaatagttttgaaaagtcacaaaataaacaaacaatgcaaaataaacagcaacaacaaattctggggaaaagaatctgatttctagaattaacacattttaatattcaaaatgttcagttttcaataaaaaattatgaggaatgcaaagaagataatatgacccacagacacacagaaaaaagaaatgaataaaacctgtcctcaaagacacctttgttattggtcttactagataaagaatttaaatcaactgttctaaatgtgcacaaaaagctaaatgaaaccagacaactaacagaaagcaggtgagcgatgccctgccaaatataaaatattaatatacagaacaaaattacaaaaatgtaattaggaatgtctggagctgacaagtacaaaaactaaatttttttaaaatcagtcaaaggatttaataaaagattggagctcaaagagaacaaagaatcagcaaaattgaagacactgatggagattactcattctgtggagcagagaaaaagaatggtgaaaaatggacagtgcctaagagatctatgagacaacatcaagcataccaacaagttaataacaagagttgctaatgaagaggagaaaagggaaccaaaaatatctgaagaaataatgtctgaagaccttctaaactgatgaaagacatgaatctctatgcccaagactctcaagaaactataattaggataagctcaaagaacttcaaactgagagaaataataaattgtcacaagacaaagaatctcaaaagtagcaagagataagggactaaccatgtacaaaggatctgaaataagattaacagccagacttttattaggaaccatgaaggccagaggcagtaggataatggcacctttcaagtgccaaaagaaaaaaaatatatatcaaaaattctacatttggcaaaactgcctttcaaaaatgaaagagaaattaaaacattcctagatcaacagaatctgagagaatttattagtactagatctgtcctacaagaaatgcaaaaggaagtccttaaggttgaaacaaaaggacattagacagtaactccaatcgaaacacacaaaaaattcaaatggtaaaagtaactactgtaagtaaatgcaaaagccagtcttattgtattcttggcttttatgttctctcttttttctatatgatttaaaagacaaatacataaaacaataattataaatctatggtaatgtgcacgctatttatgaaggcataaaatgagacaataagaagacaaaggacagggacaaagccgtataggaggagagtttttatataatattaaggcttagttagtattaatgcaagctagattgttataaattcaagatgctaattgcaattccaagtattaacactaggtaaataatgactacaaacaaatacaaaaggaattaaaatggcacattagaaaaaaacaaacacaaaagaaggcatacacagaaaaactgaaaacaaaaaagatgtaatacgtatggaaaacaaatagcaaaatggtataagtcctttatcagtttataatttactctaaatgtaaataaactaaactcccaactaaaagacagaaattggcaaaataggctgggcatggtggcttacacctgtaatcccagcactttgggaggctgaggtgggcggatcacgaggtcaggagtttgagaccagcctgaccaatacagtgaaaccccatctctactaaaaaaaaaaaaaaaatacaaaaattagccaggtgtagtggtgtacacctgtaatcccagctactcgggaggctgaggcagaagaactgcttgaacgctggaggcagaggttgcagagagtcaagatcgcaccactgcactccagcctgggtgatgcagtaagactctgtctcaaaaaaaaaataaaataaaataaataataaaaataaaaataaattggcaaaataaataaaaatatatgatccaggtatatattgtctacaagacactctctttagatacaaacacacaacacaataggttgaaattgaaatgacagaagaggatagtaacctaaagaatgccagggtggctatactgagacaaaagagactttaaatcaaaaattgttacaagagaaaaacactacatattgattaaaaaaaaaaaaaaactaagtctacaaagaagacatagtaacagaaatagaaataaatcatcctgaagtttacatagaatttcaagggatctcaactagccaaaataatcttgaaaacccatgcatgtatggtaaaatgattttcaacaaagttgtcaagaacagtcaatagggaaaggacaatttttctaacaaatagtgttggtaaaactggatagccacatgcaaaacaaaacaaaaacaaaaaaattaactcaaaatgaatcaaagacctaaatctaagaactaaaggtacaaaactcatggcagaacacataggagaatggattcgtgtggcaatgttttcttggatataataccaaaaaccacaggcaacagaaataaaaataaattggaccacatcaaacttaaaaattgtgcatcaaaggacacagttaactgaatgaaaagacaaccaacacaacaggaggaaatatttgcaattcatgtatctgatgaggaattaatataaaaaatatataaagaacccctacaactcaaaacaaacaaaataacctgattcaaagatggacaaaggatttgaacagacatttctccattaaagatatataaatggtcagcaagcttatgaaaatatgctcaacatcactgatcattagggaaatacaaatcaaaaccacagtgaaaaattaccatacacccattacaatggctgctatcaaaacaacaaaagaaaataacgagtgttggcaaggatatggagaaatcagaatcctgtacactgaggatgggactgtaaaatggtgcaccttctgtagaaaacaggtcggtgtttcctcaaggaattaaaaatagaattaccataggttccagccataccacttctgagtatataaccaaaagaactgaaagaaggatctcaaagaatagttgtaccccatgttcacagtagcattattcacaacagttaaaaggaggaaggaacccaaatgtccactgacagatgaatgaataaacaaaacatgggtacaatgaaatatcattcaacatcagaaaggagataaattctgacacatgctacaacactgaggaagcttgaggacattacgctaggtgaaataagccagtcacaataagacaaatactgtatgatttcacttatatgagatatagcaaaaatagtgaaactcatagaaacagaaagtaggatggtggttgccaggggcaaggaggaggggaaaatggggagttattgtttaatgggtagagaatttcaatttcccaagatgaaaaaattctggtgattagatgtacaatatgaatatacttaacactgcttctgaactgtacatccaaaaatagttaagattgctaaagcaaaaaactaacaataaataaagatgcctgctttggccacatatattcaacattgtactaaaaatttcagccagaggaattaggctaagtaaataaataaataaacccaaattagaaagaaagaaatgaaatagttttgtttgcagatgacatgatcttatatgcagaaaatactaaagaatccacaaagaaactactagaagtaggaaacaaattcagcaaaattacaagatacaagatcaacactcaaaaattatttgtgtactcattacaatgagcagtcaaaaagcaaattaacaattccacttacaatagcatttaaacaaaagaaattttaggcttgtgggccatcacagtctctactgcaaccagtcaactctgccctcgtagtgtgaaagtactcacaggctatacataaatacatgagtatggctgagtcccgataaaactttatagacactgaagtctgaatttcatataatttacgatagcatttaaatgaaaaactatttaataaatttaagcaaggatatgcaacacttgtacactgaaaactacaaaatattaatgaaggaaagaagacctagggaaaaaaaatcttatgttcattgattataagatttaatattaagataacactccccaaagtgttatcacccactctaatacttacccaatccaatacttatcaaaaactcaacatacttttttgcagaaatagaaaagctaactaaaaattcctatggattgcaaagcaccctgctgtggaaaactgtcggtttcacaataaattaaatgtaaaattaccatatcacccagcaatttcacttgtacgtatatacccaaaacaactgaaagcatgtattcaaacaaatatttgtacatgaatgctcataggagcactctccacaatagcgaaacacaggatgacccccaatgtccatcaacagatgaatggataaacaaaaggtgatatatccatataatagaatattgttcagtcataaaaagggacaaagtactgatatacaactacaacataaatgggtcttgaaaacattattctaagtgagagatcagacacaaattgtatgattccattcatatgccatatccaaaataggcaaatctataaagacagaaaggagattattggttgttaggggctgggagcacagcggggaaaagggagcaactgcttattaagttacaatactgcttattaagggtgatgtgtttccttttggtgtgatgaaaatattccagaaataaatggtggttatggttgtacaacattgtgaatgtactaaagtcactgaattctatactttaaaatggcttgtgaatttcatgtgatgtgtgttttaccacaattttttttttaggtagaatccctcgaaagttattgcaaatattccagttctgcccagtctctaaggctgtcacaaagcctgccacatcctaacaacccatgatcaccctagcctaccaggactgtttctttaaacaaccatgagtcctaatgctacacaattcattggatttttttttttttttttttttttcctgagacggagtctcactctgttgcccaggctggagcgcagtggcacaatctcggctcactgcaacctccacctcctgggttcaagtgatactcctgcctcagcctcctgactagctgggattacaggcacgcaccaccatgcccagctaatttttgtaattttagtagagacagggtttcaccatgttggtcaggctggtctcgaactcctgacctcatgatccacccgccttagccttccaaagtgctgggattacaggcgtgagccaatgtgcccggcctatttgaattttttaatcatatactttcttttgctatctgttaagttttcccctggactgcacatgaattactcactttgttgtactacttttttaagtacctgcaagactgtcatcagaagtttcacaatgtcacctaataaagcccaccgacaaactgttttatgttccagtttcacaactgtaagatcacaagatctgcattcacctatatgacatttttgtcttactcttcatcaactctctatcagaaatcagcaaacattttctgtaaagagtcacacagtaaatattttaggcttgtaggccattacagtctctgctgcaaccagtcaactctgcctttgtagtgtgaaagtaccaacaggcaatacataaatacatgagtatagctgagtcccaataaaaattcatagacaatgaagtctgaatttcatacaatttccaagcaaaataatactcttggtttttttccctcagccacctaaaagtataaaaaccatccttcatttgtggaccataaaaaaacagacagtaggctgcatttgacccatgaactgtaatgtgacctctcctctatattttccaggatgttatttctactttcatatgaatgtatagacattttttaaacctcaataattagttttaagcaaaactgtgaaaaaataaacaacttacctgggatgtgatcatattccactagtgttggcagagcagagaaaaccgagagggtgtagcttacaaacaagaaaagaacatgagaaatgtcacttgcctaaaaatgtccacctcccagctggcaaaacatctctaaaagggagatactcacacgtccatgcatgactctggcatggttatgtactgcttggacacattagttttcaaatgtgaaaacgtttggttttctactgacttataaacaacttatgctgtactctaacagagtatgcaaaccaatatattaaactaattaagcaagttaggaaaagccaaagaatggaacataatactttcattaaaactgatgctaaacaaaaatattcaggttttaatctttattataaaccagagaatcccaacaaggttttgaaaaaagtgatgtggtatttttcagcccagtttttttttgtttgcttttttgagacagagtcctgccctgtcacccaggctggagtgcaatggcacagtcttggctcactgtaacctctgcctcctgggttcaggtgattctcctgcctcagcctcccaagtagctgggactacaggtgcgcaccaccacgtcgggctaattttttgtatttttagtaaagacggggtttcaccatgttggtcaggctggtctcgaactcctgacctcgtgatctgccggcctcagcctcccaaagtgctgtgattacaggcgtgagccactgcgcccggcagagcccagtttttttggaaggaaaacgaacttgctctaacttggtttcaggttctcaaaaccatctttggattttaaaaagcaaacggattttttcttactctgttgtcaatgcagcaaacacctgcctgagtcctcaagcgactcagtgtctgttcttgactctgccacaacaaaatgtgtcaatgtcaacagtcacttaacatgttaagcttgtttcctgtccaccccaccccatcccatcttttaaataaagccgaaatagataacttacagacctttcttgcggctgcacctctgattctgtaagatcaagatgggggcatccgtacatctctagttgtgctgcaatatgccagcagctcaacatcgagaacgagcgagtaacgaatccaggcatggagggtgctgtcctccacttggctgctaagctcggccctccgcatgatgccttcacaactccccaagaagcggtgctgtctgctccttcggccttgccctcctctgccgccacatctgaatgggcacaaatctcccaccatcacccagcctgtgggagtctgaacaggacacaaatcgagcctctgctcctcccatccgtgctctagatctctaatgaggtctcggcccaacaggtccgatgtcctcctaggagggcccctgcaccctcacccctcctttcccttctcaccccacaacagatgttttgctccaagacagctgggcctaagcccttcagttcgaatcctcatccaagactgaaagctcctacatcttcctgtcactttagccacaagctgcaccgtctggaaatgcccactgctactagggacacaggcgaggccggacagtgccggaggacccggggtgcctccctccacgtgcgcggcctcacaggtcagtggaaacaagaaatcccccaatccacagccacgatgacttcaaaatacttcctgaaggcatcaggccatgaagctgcgacctgcgaggacacagcaagcggggtgacgctgagcagaggcttggtgtggagtccgcgcccgcagggtccctccccgccccgcgggtgcttcccgccacctcgctcgcctctgcgtcgcagtgacaacgcggggatgccgaccacaggtggttggaaggagacagcgagattctgaggggaaagaataaggagagaagcagcatcttttgggcagaaggcccgtttccgcacggtcctgccgaggcctccgggcatccttcacctcagggaagagaaaatccaaccttacttatcacaggcgcgggacctacgttcccttcgggagcagaagaaccaggacaggattaggacgcaggccaggcggcaaagccgctccctctctcccacctccaggacaagcggcacctccagtccaccctcgctccagccctcccgtactctacccccggcatcctctgccccgaagcagggagatgccgggagccctccctaccaggctgtaccggagaaaaacaaacctggagccacaccgcgcacatgcgcagaaagcccaaagcggctcccgcgaccggggccaaaaagtgcacactacatttcccacaagtcctcgcgccgctcccttagaaagtacacgctacatttcccacaagccctcgcgccgctccctgagaaagtgaagactacatttcccagaagtcctcgcgccgctcctttagaaacggcctgaggtttcagcgccgttcggtagttagttcccagatgcaccgagtgcaatactgcaattttattcgttagctgaaataaattatgagtatttaaattacacaggtttcttatgaattacatctccctgatgatttggctgtcctcaacacttcctcgtttggcagaattcaggagtggaatttctccagacacggtcggttcctgtggccccgctgcgccgcggcggcaccacctccacttgcgcctgtggctccacttgcttggttctggtccactggacgctcaccctgagaaaacacgctggacatgagcattaccagcctgtacactgttgtaaagataactcggaattgctcttcaaattttatttgttaaaccacgtaataccatcttttatgacaaacctgcattttccattcttcaggagtatgttggatctcttgatcaaaataactttttaaaatgttcactgacagaggtaacacaggagtggataactaaaaaacgtacgttctcacttataagtgggagctaagctatgagtacgcagaggcatacagagtgatacaatggactttagagactcagaagggggctggtgggaaggaggccggagatttaaaaaactacacatggccaggcgcagtggctcatgcctgtaatctcagcactttgggaggcggaggcgggagtcaggagttcaagacaagcctagccaacatggtgaaaccacgtctctactaaaaatacaaaattagctgggcgtggtggcacacatttgcagtctcagctatttgggaggctgaggcaggggaattgcttgaacccgagaggtggaggttgcagtgagccgaaatcgcgtcattgcactccggcctgggcaacaagagtgaaactcagtttcaaaaaacaaaacaaaacaaaaaactacacattaggtacagtgtacactactcgggtgacaggtgcactaagatctcaaaattcaccattttataattcatccataaccaaaaaccaattgtactccaacagctattgaagtttaagttaaaaataaaaaataaatgtccactgaccaaaacagaagcatttttctccatttctattcctttttttttttttttgagacggagtctcactctgttacccaggctggagtgcagtggcgcaatctcaactccctgcaacctctgcctcctgggttcaagcgaatctcctgcctcagtctcccgagtacctgggactacagacgtgcaccaccaagcctggctaatttttttgtatttttagtagaaacggggtttcaccatgttggccaggatggtctcgatctcttgacctcgtgatccgcccgcctcagcctcccaaagtgctgggattacaggagtgagccaccgcgcccggcttctattcccttctttaccaccactgatgataatcccacttgttcccatgctggaaaagcatttagtaccatccacgtaaaagagtcagtttattcaagggatgagatgtatttcagaagacatcatggcaagtacagtaatgattatcatttcaagtcacaatttattttcctgctcatgattttttttctttttctttttttttttttttttttgagggagtctcactgtcacccaggctggagtgcagtagcatgatcttggctcactgcaacctccgcctcctgggttcaagcgattctcctgcctcagcgtcccaagtagctggtactacaggcttgtaccaccacacctggctaatttttgtaattttagtagagacagggcttcactatgttggccaggctggttttgaactcctgaccttgtgatctgcccgccttggcctcccaaagtgctgggattacaggcatgagccacggcacccggcctaatgtttttccattttaagaacagtcttgacacttgtgaatattccatttttttttttttcagactgggtctcattctgtctcccaggctggagtgcagtggcatgatctcgggtcactgcaactgccgcctccaagattcaagtgattctcctgcctcagcctccccagtagctgggattacaggcacatgccaccatgtctggctaatttttcatattttcagtagagacaagttttcaccatattgaccaggctggtctcgaattcctgacctcaagtgatccacccgcctcagcctcccaaagtgctgggattacaggtgtgagccacctcacccagcctccattatttctttaatggttcaggttccattatgccatggattatttcagtaacattgtttgctctttcaatttgtataatcctatccctaaagagattgaaaactatgaacatgccactcccagcctccttgggacttgacacatcctcctgggatcatctcagatgggactgactgtgccggcaccatggaggtggtgctgatctttctatgcagcctgttggcccacattgtcctggccgatgcagttgagagggagaagcaaattgacccttttcattatgactaccagaccctgaggattagggggttggtatgtgctgtggtcctcttctccattgggatcctccttatcctaggttgcagatgcaagtgcagtttcaatcagaagcccaggaccccaggagaggaggaagcccaggtggagaacctcatcactgcaaatgcaacaaagctccagaaagcagagagctgaatgaagtgcagccttccagtgggaagcctctggaacctgaaggcagctgcttgaacttttagatgcaaatgttgatgcttaagaaaacagccacttcagcaacaaatctttccccaagagaagccaataacttgtgtgtccccccatgcccttccctgtcccttctaacaccattcctccacctgatgatccaactaatctcttgcctcaccactgcagcctgcaggctcctccaactcctgtgatgtgtctgtgtgtgtgtttgctgactgtaatgttcatggctacttgttcatggttattatagttagtgaactgtggactcactttcctgggcagaggctgagccatgcggccatctgctcctatctgccccccatcacctctcactcctgggggtctgcttttttccctggagagtctagctccttccctttagagcatgggcaggagtctccagttgtcttgggacctgggaaggtttgcatcactttcatcatctttctttatggagtctcttcactccttttacaagaacctcgcttccttatcccactccaacctcagtctgttctgaagatcagcaattagagatacaaagcaaagcaaggagtttgtaagcccagcattgccttcaggaggctactatacccttccacggttatttttctccctggggaagccccagggggctccatctgccctgcccttcacatagcacccagggattccaggtccggggctgctgctttttttctttttttttccagagtcccactctgtcacccaaaccagaatgcagtggcacgatctcagctcactgcaacctgggttcaagggattctcatgcctgggtctcccgagtagctgggattataggcaggcagcaccacactcagctaatttttgtatttttagtagagatgtggtttttcctggcctcaagcaatccacctaccttggcctcccaaaattctgggattacaggtgtcagccaccatgcccagcccaggcccagggcttctaatctgcccttggggaatgtagcccttacatatcttatcagcaataaccacaggggctctggtatcccacccatctccaaccttcctgcttctaagacttcaacctacagccgagtttttgtggacacaggcttccgtccttgaagttgagtctccagcaggtgatgactgaaggattcccattctgttgctgccagcacactggaatggacagagggagagtaaggggcctttgcttctccgcccatgtccccttggtcagcagagaactcctgcatcctttgctctgcctgtcagtggtcagagaggtgagtgaggtaggttagagacccagtaggctccatgcagcactgctgcagagggtacaggaagaggccaaaggtcataatgacagcgggagctcaaacaagatcccgcccttcctgtcctccatgtgcctgtggaaatcaaccaaccgagcctctgtgccagactgctgttttctgtatcacgatctgtctgaacaacagaaaaaaggaataaaatatttgtttcctagtgaaaaaaaaaaaaaaaacatgaacaaaaaacaagtaaacttcaatcaatggattatttttaaagtaaacaaaaattttggaatcttttcttgagaattaaaatatttcaagactttacataaacaactttctcaactgtgttagttacaggagccaatgagtttctaactacaaaggaaatgaagaatattgaatgccaaaaaaaatcaaacaatcctttaatcactcaattctaatcgtgtaaatgctgaagtaagagaacaattttatgacagttacttcaatgaaaatgcaaagaacatcagatgctatttggacctcatgatgcagaatgtgggtcggacggcccacaagttggaatcattcatgctgtacttcagcttggaccaagcatgtctgtgcctttatgcaaacatcaaccacaatttgtatttgtgttatcgccaccaaaagcagttcagaagcaaagggaaaatatcttctgccttgtgcttacttgtatccatggctctgctgtaaataggtgaggcatttagatcattgatcatctctgtgatcatagtgaagctattacttttgttgttgttgcagtagatttcatcctggctcttcaaaatttgattgcatctttgaaatcagaaaatacttctagcagtagtactttcaaattgtcatttgagctgaaagactgctcctgttatatagtgtggcagatagttacaacttccactgcaattactatatctcaatctgaattctttttattttttattttttttgaggcagtctcgctctgttgcccagttgacaccatcatacagtggtgcaatctcagctcactgcaacctccacctcccaagttcaagcaattctctttcctcagcctcccgagtagctggaattacaggtgctcaccaccatgccacgctaattttttgtaattttagtagagacaaggtttcaccatgttgcctaggctggtcttgaactactgagctcaggcaatccacccacctaggcctcccaaagtgcaaggattacaagtgtgtgtcaccgcactcggtcttgaattctttttaataaaaaaatttgtttaccactttatatagtattagttgaggaaatcatacatcttccatgtttagctgttactatgtgctggtgcctttctctatttttgcatactgcacaaaaagcttcaaaaggaatctttcctcatttaataaatctccacttttcaaacaattcatcgcaaagtatatgcttgaattttggtatttggcattcaaatatacacaaataaaaataggtaatagcaaccatgacaaaaattgagctgagtgaatttgataatctcacagctgccttagcgtgtctgtcactcataagtctgaactcaggactaacatcaaacaggggttgaaccattgaaagcattacaaacttgcaaactaataatcaattgaagtggccaggcatggtggctcacacctgtaatcccagcactttggaaggctgaggctggtggatcacaaggtcaggagattgagaccatcctggccaacacggtgacactctgtctgtactaaaaaaaatataaaaattagctggatgtggtggcacatgcttgtaaccctagctactccggaggctgaggcatgagaatcgcttgaacccgagagttagaggttgcagtgagccaaaattgcgccactacactccagcctggtgatagagtgagattccttctcaaaaaaaaaaaaaaagaaaagaaaaaaaatcaattgaagtagagttgcctttgaagtggcctgagacggctatcctatccttgtctggtatctgggaatgtgaattttgggaaggtttgggaacctggatttcagaagggttccctcctccctcactgatcaaatggctcactgtacctaaacaatatggtttctgcggaacacctgctttttttctgggaatctggaatcttgatttctgcacaatagacagtgtctacacgagcagccccccaataaaaagcccaggcactgagtctctaaggagcttctgtgacaacattttgcatttgttgtcacagcatgttgctggaggaattcagcacatcctatgtggctccactaggagaggatgcttggaagctggtaccaggtttcctctggacatggccctgtgacctctcccctttgctgaccttgctgtaataagttgtagccatactgtgactatatgccaagtcctgtcagtcctcctagcaatttgtttagcccagaagtgttcttgggaatccccaatacagttggcatcagaagcaaatttttttttacttctgactctgtcacccaggctggagtgcagtggcacaatcatagctcactgcagccttgagctcctgggcacaagtgatcctcctgcctcagctgggactacaggtatgtatcctcctgaatagctgggactacaagcacgtgccaccatcccgggctctttttttttttttctgtaaagatggggtcctgctatgttgcccaggtttatcttgagctcctggccttaagtgatcctcctgcctcagcctctctaagtgctgagattacaggtgtgagtcattgcacctggcccagaagtggaatttgctagaacagtcctgattcactaagatttggctccatcactgtttgggaaaaggaagaatgaaggggaatggtgataagccttggtgtctatcgagccctccatggtttgagagcagcagctgaactgccatctgctgttagaagccacagtgacctttggggttagaaatggatccaaccctggcttctttgagctgtgctggatgaagtgagggggaaagtatacatctggggattggctttgttttttattctcttctccaggtgggagggtaaaaaaacaacagtgacaaattataaaggtgagtgttaggtggccccaaaaatgttagaagttctcagggctggagcaaagctggggtgggagggtgggagggtgggagggtggggagggcaccaagactccatccagcctcttcttcagcccagctgctgccctgttgcaagagctgcctccttctttaccaccccctgtaccctcccccatctgctttccaacctgaatctttcccacagcagtaatgctaacctaactgcaaatgctggatttactgctatggatttagtttgcaacagaaaaaaaaatttaatggctttgtgttttgtggctattacatctagatgtattaatatgataaaattgatataaaatgttaaatgctttcaatttcataaattctagagggaacacacttatcaggaaaagctgcagcggaaagtgaaggtgatacaacttccttgctttttgcagctagtgggcagcttggaatttaaattctcaatactggaaacagaacaagtccccaaaattaacaatttttgctacagtttttgtctattggagccactggaaaaaaggagacaatatgaagagaggcaatcttgagctagagatacgctttggaatttacaaggcagtttttcatctctaatgagctcttgtaagatcatatagctgaccctcagaggctgatgattttctggccccatgtgtatagttttgagttgctcagcttggactctaaggtgaataatgtaaaaagagcccaacaaagccttgcttgtcacttggctaagaacacagctgtctggccctgcagcatctcagtctccagttactggaagaacatatattagatgttggggaaactataaggctacaggatgatgctgcatgttggcagggagaattgttcaaggtagaaactgtggggaacaaagaaagagattctcatctgtgtacctgctgctacatgctaatttgggagtaagaaaactgttaaggaataaaaaagccaagaactctgtcttcacagggctttcaggctagaagggaaactggccaccatacaaattgtatacaactccattagtacttaagaggtctgatttattgctttgaaacacaagtgcaggaagtttaaggtttatcagcagcctttccctttgcagaaattgtaaactaaaaatgaaatcctaagcccccaccaactgaaggacactccccttagccaaggggaccccagaaaaatcttacaattgagttcctggccatgatgggatgggaggtcagacatgtctcattataccccctcatgtttgtggtttagacacagcgactgaccagcattaatgttaaaatagagatcataagactggcagaacagactttttgtggcaatgagatatcaattataaacaagacctaaggccatgccaggcaagggttaggtcaagcactctaaacttaaagattaactatggtctaactgccacaaggtttttcttttttctctagcagctaaataaacactggccttgacataagcaaaataaaaacaattgtagctcatcaccagacactaattggctcccaactcctgtcccaagcaccataactacagctttgattagacaagagactgatttcagtaactttctcctgataagaagaccacccaccatgaactggttctggctggttttacagagattgcacacttgagtgcgttcgtgtcctgtaaagaccttttgactgatagggcctaattataatacattcaagtgttaggactccaccccaaagtgaacatgggtcatgtattacatgcatgttggttcaatacatgtgcctcaggaccaccttcatgcatattcatagctcctcctataacctgttgaagatgtatgtttagctaacttgtccagcataatgctcctaccccaacctatattccttcaaagtgcctgtccctagtccctggtcttagccagaggcattcttctcagcctgttgcaggctgtaaccccttataagaaataaagcctcctctccattccaaatagttaaatcttgtgaattgtttttgttttgttttgttttgttttgttttgttttgttttgttttgagatggagtttcactcttgtcacccaggctggaatgcaatggcacgatcttgtgtcactgcaacttctgcctcccaggttcaagcgattctcttgcctcagtctcctgagtagctgggaatacaagcacctgccaccatgcctggctaatttttgtatttttagtagaggtggggtttcatcatgttggccaggctggtctcaaaatcctgacttcaggtgatccacctgtctctgcctcccaaagtgctgggattacagctgtgagccaccgcacctggcctaaatcttgtgatttttaaattcaacagagtcaattaaatggttccttgatagagaaacatttaaggcagacattagcttttattgccccataacgcttcagtaagtttccctgaatatttgcatttacttgtcaatcaactcacagggactgaggcagaagtaaaacccacaattaccttacccctggcctgtgtgacaaagtaacaaatcttttatcacatatttgagaggcatctcagctaccaagaactttttttttaaccttttattttaggttcagggggatatgtgcaggtttgttatgtaggtaaactcgtatcacaggggtttgttgtacagattatttcatcacccaggtactaggcctagtacccaataattattttttctggtcctctccctcctcctactccaccctcatgtaggcccagtgtctgctgttcccctttgtgtccatgggttctcattatttagctcccacttataagtgagactgggcgattgctgacctgcatcactcttgggtggatctaacaggacataagtaaaagacccttggccacaaccactaccaaagtccctttttctgctgcctccaagttggggaggaaacataagccctaagatcaccccagagctgtggtgagaagcccaggagagaaaaaaacctgagtagttttaaactagaatatccatgtggctttttaaagatgtttgcaatttttttgctattctccctttgagatatgggggtctatgcccacccttaccagactggacactagtgctcacttgtcactgacacatgacatgaaagtgatgctgtgtaacttccaaagttatgtttaaaaaggccatgagcatctgcctggttcactcaggtcactcacctatggtgcccttgatcaccaagtcaaagctctgaatgtcctgagagtgctctgctacctggaatcccagggtaactgggaggtctcctataggtcctgaagccaagccccatgtcctctgcagacatgtgagtgaagtcacctccagatgatgccaaccctttgctgtggattcaactccggccaatgagtcttctctgcagtccccaaacaccaataaacagcaataagccatcttttctgtttcttcctagccctgtgaaccatgaacaaaataaaatggttgtttcatgcattattttacggtggtggttctttcttttaaaaaaattcacggtaaaagcgccaagaataacacacttgtaggacattcacaaggcacaaaataacatacattgaaatctaggtttccttctttccttcttccacagcctatcaggttctgcctctggaagtaataatggttaagtttctgcacatctttccagatttattaattaaacaatcatatagcactgacactgtgaggaagctttttaagggctttgcttatatttattcacttactcttcactcactgcggacactcaggtggcagcaggaaggaaagtgttttgctcaaccaaatgaaagtttgatctgctctttgaatgctgttccttcaatcagataattctattttcttcatatattaccaagtctttttattttctcccctaattgagcattcagagatgtgactctgttttctagtttttcttacgtttcaccactaaatcttaaatttcatatgagacagacagtgatgaaattcctgtcactggacatatatatgtatgtttatgatggtgccttacacatacacatttttctatctagcgattaaccattaaaactctatactcagagtgaggaaacattacacgttccttcccaaaccctgtcaactaccctgtcaattaaataatccctgaaaaaatggcaacatctatattaatgcggtttttatatctcatcaatgacccatttgataaaatagttctagaaacttgtaatgaaccagcagtgatggaaatttgtactgaactatttcatatctaaaagggtatctactttgttttagacatgacaactctctcatgttttagaattttccattgttgcatgtttaaagggcttgtcaattcccttccctttcctaattctcatgaccagatcataagaatgtgtgtgatcaggctggttgatgtgccacaacacatctttaatcctggaatttagggttatcagaagtctccatttaaaaaagtatcatatgctttcaaacaacccactgttgaacatatagtgcttcatttctcttaatgtctcagtgaatagccagccttttatgcatacatgaatagaggatctctcaacaaattcagagattcagaaataagtacataaacttagttgcatagagagaaaaaataggtaatatacataagtgataaaagaaggttttatataattactttttcaaactaaatttataatagtgctttttaaactaaatctggaacaaattttaaattatttaatctagaaatgtccagtgattcaggaacagtagaaatgggtgaggagagcatttcaactcaagcaaggaactccttttattctcaacacattagctttttccctcttcactctaaaatgttcactatcaaatataattgagaggtcttttttcctcatttaacatttatttcatacacagagaataatactgtgggtctgagattcagtttttgaaatgcaacatatactctaagtgacccttttacccatgtcaaaatagcagcagttggaccccataatgtggcatgtattcatttgaaaattctacagtgacctatcactgtgatcatgtgatgaagcatatcttgccttccattctaactgtcactctgtgagcttcgaggttcaagtttgacagcatttgtcaatttcggaatgtcatacaaagaacgctcaaatatggggaattttatgtactgttgctgagatatgttcactttcatcttccgatcatggtttcttcaaataggccagttcacttgtactcaaaatctcttcctcatttttttgtttcccccactccaattcgtctatggatttatgaacatattttatagtattattactgatttgtacttttgattcttccaccaagcgttttgtcttaaatattttcctatttttagaaaaatgtactgtttctaaacacttttgtacacaatgtttcataggatacagaaaaaacacaaccacactgtcttcatcagatgaggagaatcttgataccaaatacagtatgagacattccatgaaagggaaattatagaccaaagtcttctgagtataaaagtcaaaatctgaaaccaaatattagagtggtctaaatctggagatttttaggaaaagaaactgaaatttcatggtgggaaacataattttgcttagcttagaggttttgagggattgttttaaagaaaaatttaaaagataaataacattaaatggatataaaagttataaaataaaaatataaagttataaaaattaaaataaaaatatattcatatattaatataaaattgtaaaaatattataaaaggttataaaaatattataaaaggttacaaaattcttttgctgtcaagattgactgggattagatttgtttataaggtcttattaaaattagccataatattaaaaatacggctgggtgcggtggctcacgcctgtaatcccagcactttgggaggctgaggcaggcagatcaccaggtcaggagaaagagaccatcctggctaacaaagtgaaaccccgtctctactaaaaatataaacattagccgggcatggtggcgggcgcctgtagtcccagctacttgggaggctgaggcaggagaatggcgtgaacccgggaggcggagcttgcagtgagccgagattgcgttactgcattccagcctgagcaacagagcaagactctgtctcaaaaaaataaaaataaataaataaataaataaataaaaatattaaaaatacattaatatccaactaaattttttttaaaaaaataagcgtaagattttttccccatcgaacttaacaaaaagagtatgtattcccgtgtgccagagtgccagatcaccacatactattatgttgggtttgcatatttgatgatgtgtcgctaccaggatgccatccgggtctttgccaacagcctcctctacatccagaggaccaagagcatgttccagaggaccacatacaagtatgagatgattaacaagcagaatgagcagatgcatgcactgctggccattgccctcacggtgtaccccatgagtatcgatgagagcattcacctccagctgcagaagaaacacagggacaagatgctgcgcatgcagaaaggtgacccacaagtctatgaagaacttttcagttacttctgccccaagttcctgtcgcctgtagtgcccaactatgataatgtgcaccccaactaccacaaagagcccttcctgcagcagctgaaggtgttttctgatgaagtacagcagcaggcccagctttcaaccatccacagcttcctcaagctctacaccaccatgcctgtggccaagctggctggcttcctggacctcacagagcaggagttcaggatccagcttcttgtcttcaaacacaagatgaagaacctggtgtggaccagcggcatctcaatcctggatggtgaatttcagtcagcctcagaggttgacttctacattgataaggacatgatccacatcgcggacaccaaggtctccaggcgctatggggatttcttcatccgtcggatccaaaaattggaggagcttaatcgaaccctgaagaagatgggacagagaccctgatgacattcacacacattatttaggaacctgttttgatatattacaggcaggaagtgtttttgctaccgtgaaacctttacctagatcagccatcagcctgtctactcagttaacaagttaaggaccgacgtgtttcaagtggatatcagtaaaggatctttggagccagaaaaaaaaaaaaaagatttgttctcaatgagattacacacagtaataatttttaattctcaaatctgtttctttttaaaacttctgagatttgtatctcagaagttcaacctttactatatttttttacacattatttacagatcacacatcattaccctttgtttcttttctccttcaaaaggtaaatctttttacttggctagaatggtaactttgtacttcaacttttccatcagctcttttaacttttccctcatattctatttctgctgttataataccaaaatattgatcccaaaggtaaaaataaattctttctcaggggtaacatgattttttactcttaactttttgatatgtctgaattgttgcatgtaatcaggaaacttcccatgctattaggttggtgcacaagtaattgtggtttttgccattactttcaatggcaaaaactgcaattaccgcaccaacctaatactaggagccatatatccacctgctcaaggtgctagctttcatgtttacattcttctataatacaatgttcactcatgaccttgaatacattgtgcctgtgtctaattaaattcaagtatctttttcatcaggtttgacttccaagttatttaaaccgactttacttaggcacttcccattctcaagtatgccttagtccaggttgttcagatagttgctcagattaagccagtgagatgattggggtcacagatttaattcattaagccactaaagcatcagcccagatagccatattttcagttaatttcaattagctgctcatgaagggttggccagttgaatggaagttgattcttggcacagccttcaagtggcaattggtttaaaatgtcctgagttctgagccagcctgggggctgatacagtttggatatgcgtccctgcccaaatcttatggtggattgtaatcctcaatattggagacaactggttgagaggtgactgggtcatgagagtgtatgtctcataaatggtttagcatcatccccttgttgctgctcttgcaacagtgagatttggttgtttaaaagtgtgtgacacctcctcctaccttgctcctactctggccttgtgatgtgcatgctcccacttagccttctgttatgattctaagtttcctgaggcctccccagaagccacgcagatgtccgtatcatgcttcctgtaaagctttcagaacgctgagccaattaaatctcttttctatataaattacccagtctcaggaatttgttgttgttgttttatttggggggttttttgtttgttttgagacagagtctcactctcacccaggctggagtgcagtggcatgatctcggctcactgcaacctccatcttctgagttcaagcgattctcctgccttggcctcctgagtagctgggattacagacgcatgccaccatgcccagctaatttttgtatttttagtagagacagggtttcactatgttggtcaggctggtctcaaacttttgacctcgtgatctgcccaccttggcttcccaaagtgctgggattacaggcgtgagccaccgtgcccagccaggaatttctttacagcaatgtgagaatggccgaatacagaaaattagtactaaggagtggggcattagtataaaggtacctgaaaatgaggaagcacctttggaactgggtaatgggcagaggttgaaagagtctggagaacttggaagaagacaggaagatgagggaaagtttagaacttcttagaaattggttaaatggttgtgaccaaaatgctgatagtgatatagaaagtgaagtccaggctgatgaggtctcagatggaaatgaggaacttattggaaactagagcaaaggtcacgcatgttatgccttagcaaagagcttggctggattccatccaagtcctagggatctatggaagtttaaacttgagagtgatgtcctagagtatctggcaaaaaaaaatttctaagcaacaaagtgttcaagaagtggcatgggccaagcatggtggctcatgccagtaatcctagcactttgagaggccaaggcaggcagatagcttgagcccaagagttcaagaccagcctgggaaacatggcaaaatcccatctctgactaaaaatataaaaaaaaatacctggcctagtggcatgagcccatagtcccagctactcaggaggctgagatgggacaattacctaagcctgggaagtccagggtgcagtgatccatgtttatgccatggcacttcagcctgggtgacagagtgagaccttgtctcaaaaacaaaacaaaacaaacaaaacaaaacaaacaaacaaaaactggtgtgactgcttctaacagcctatgctgggatgtggaagcaaagaaataagttggaacttctatttaaaaggtaaccagcaaataaaagtttggaaaatttgcatcctggagcctggccatgcagtaggaaaaaaaaaaaaaaaaaccaaaaacccaaagcccatcgtcagaagaattcaagtgggctgctgagtaaccacctgctagagaaatttgataactaaaaagaaggcaagtgctgatagcccagacaataaaaagccttgaaggcattttagagatctcagaggcagcctatccaaacacaggatcagaggcccagggaagaatggttttggaggccaggcccaggcctacactgtcctgcacatcctcaggacactgctccctgcctcttggcaactccagatccagctgtggcttaaaggggccaggggtagcttgggctgctgctctgacaagtgtaagtcataagccttggtggcttccacatggtgttaagtctgctggtgcacagaatgcaagagtgaatgaggcttggcacctctacctagatttcagaggatgtgtggaaaagcttgggtgtccagtcagaagcttgctgcaggggtggagccctcacagagaacctctactagggtggtgtagaggaaaactgtggggttggagcccccacatagagtctgtactggggcatttgctagtggagccaccatcctccagaccccaaaatggaagatctactggcagcttgcaccctgcacatggaaaaactgcaagcactaaactccagcccatgagaacagctttgggggctgaagcttgcaaagccacagaggcagagctgcccaagacctcaggagcccattgcttgcaccaatggcctggatgtgggacatggagtcaaagaaaattattattgagctttaagatttaatgattgcactgctgagttttgaatatgtgtggagcccgtagccccctttttttggcctatttatcccttttggaatggggtttgtaacccaatgcttgtacttccattgtattttggaagtaactctaacttgttttttattttacaggtggaagagatttaccttgtctcagatgagactttggacttcagacttttaagacaatgctggaatgggctaagactttgggagactgttgggaaggcataactgtattctgaaatgtgagaaggacatgagatttgggagtggcaaggggtggaataatatagtttggatatgtgtcccttcccaaatctcatgttaaattgtcatccccagcattggaggtggggcctgatgggaggtgattggctcatgggggtagttttctcatgaatggtttagcaccatccccttggtgctgtccttgcaaaagtgagttctcatgagatctggttgcataaaagtgtggggcatcttgctctcactctctcttgcttctgctgctgctatatgggatgcctatttccccttcacattccaccatgattggaagattctggaagtctcccaagaagcagatgccactatgcttcctctacatcctgcagaatgatgaaccaattaaacctcttttctttatgaattacccagtttcaagtatttctttatatcaatgcaaggatggactaatacggggccaagcagaccatggtcccttaggatggtcaactgattataaggtggcttatactgcaaggtgaggtcagggattaaaacctagaggttgaaagattctttttttattactgtttcagctcttcttttgacttagccacctcttccagggcatcagattcctgaagcaactttggggtaggagcagttgagaaagcaagtgaaaatagccctttgttcagggttcagggaattatttcaaggtcttgggtcttcagagacctcagtccccagaaaaccaattaccttcttgtgccagatccatcactcatcagtgctgtgactctgggcagaccacttcaaatctctccatttcacttccctgagctgtcaaatatgggttgtagcccctgctctgcgcattcctccaggctgatgtaagcatcacaagaaataacagatattctccatgagctgtaaagcatcatacctatggaaaaaaagaagaaaatcccatcctccactcccctggagccacccacgtttcttctctgtattcaacaactaccaaggttctggcatattcttctagacatataatgattgaacactttaggtcacttatgaattgccagtcttctaaaggctttacctccatttcaccatttttagccttataacatacgccatattaacatttcaatacctcagaacagggaactgaggcacagagaggtctctataactttgtcaggtttgtgcatcttctaagtaggacttgaacccccatctttatgcaccaggcccagtgttcttggtcactccaatatttctatattgtctcatctcaatacaggtatttgcctacatagtcagtctgttggttatgagtgcaactcacactgcaggttcttgttaaaatccaactgagattcagggggtttcgctatgcagatggtgaacaatgggtcaaacatttaaactgtcaataaatgattactcatttctctatggtctttggcaggaagatgtcaaaaactgtctttttcatagtacatttcccagcatcttgcctccagggtatgacagtagatcttcagggatcaagggaatctactgtccacaccaagctgaggaagagaatactctgccactggcctcataactaggcgcaccccggaaagcagtcaactgaaagtactgtggaaattaaattgttaagttcattcaaggataacaattctagattattcagcgtcccatatttcagacaactctaaaattgctatgccatattatttcatgtgtgcaaatttaagtttattaagtcaatcactagtgctacaactacagaagatacatttacaacttcaaaattgtttcagttttaatagcatagaatatctcaatgtagtatttagatatttagctgcttgttaaacattaactaaaatgaaacacttcctgaacaatgctgccatattttttaaattaatggacattatatgaaactgttttgaattaacataaaaactgatgaagtagtacagaaagttctcatacacccttcccccacctcagcatcctttttgtaatcacatcttacatgagtgtggtaaatgttacaatgactgaaataatattgatacattcttattaatgaaagtctagagtttggcacagaggtagagatggacaatcttgatgtccagttttttcatagctgtatgtatccagtaattaatttcccatttggtaggagggcaacagttttatcaatatttgtatcgtatgttagtgtaggcgacattacttctccattagatgctggcttcatttcttgttgtacttgaaattagacttctcacagaccagcaaggggcctgcaaccattcacatactactgagggttgccatggttatgttggccctacaggagcttgacaaaccgtaggtggtcttcttatcgggagaaagttactgaaatcagtctcttgtccaatcaaagctgcagttatggtttgtggaacaggggttggaggttagtcagtatctggtgttgagctacaattattttaatattgcttgagggtcagtgcttatttagctgctagagaaaaattaacttgtggcagttagaacacagtttattctttaagtttagggtgcgtgacttaacccttacctgttgtggccttcagtcctgtttataattcggtatctcattgccacaaatagtccattatgtcagtcttatgatcgctaatttcacagtaatgctgggcagttgtgtctaaaccataaacatgagggagtataatgagatgtgtctgaacctcctcccatctcatcatggccagaaactcagttttaaggtatttctggggtctctttgaccaagggagggcctgttcagtcagtggcgggttagaattttatttttagtttacaactcccacaaaggcaaaggctgctgctaagcatctgcacttgtgtttcaaagcaacgcactttttttttttttttttttgagacagagtcaaaagacggggcacacagaaaagtcatgcaacatggtggtcctaccaccacctacagcctctcctcctcattaaagtggcctatggagggcttagcccagcaggcttagagcttctacagaatgggtatctgctccctgggaggatgttctcgggacatccttcaattgcctgcagggattttgggggttgttttcaaagcacaagtgtggtcccggctaagagcagcctatcagcactctcctcggatgtgttggtttccttgatgggccaaaagaaagtgagaagccgctgaaaacacatacacttatttgccttcccttttttatgttacccactccaccatcacatttcctcttcctctttttctccatccttcatatcttccatatcttctctgagatggaggacaagaagtcagcaagtttgtgtctcggtgagttatttcaaggtacataccactctctcctgaggctgatgacatctgcaatcatattttaaaagcactgtgaggattatattatgctgtgcacttcacacaggtctgttttttctcttgactttaggaacctagaaggggtacagtggttacgtcaaaaatcaaagttccccaaaactagcacagaggatacctgtggaaaagataacaccttttcctgccacatttatctttcaaattgatttagattagcagtggcacagtccttaattcaaaagggaaaagtggtgctgagggagatgcctctacattacagtttatcatggaaactgtcagttggtaagagatgcccacctaataccacctcaaccaagggtattacatgtctcccataatgtacattttcagatttttatctctaaatttcactggtaaagaaataaaccaggaaagcaaaatttctgtataagaaagaagcgtggtcttacattgacaaggtcttctttatttggagatgacttgtccaaaagtttctccaaaagctaggacgacacagagtgactatcagtgccctggaggttggtgattatggatcactcagggagctgtgcttaatgtggcgcgtggaggtggttggttcacatgcatggactgagttgacacagggccatcctccagggtggaggaaggatggcaaagaggagcagcaggaaagaaatgagaaaccaccaggagcctggaagaaggacaggtttcccctagaagcatcagagggaacctggccctgcctatggattttgcactactagctccgagaactgagacatttctgtttttttaaccccccagtttatggtccatgtgatttcaggcctaggaagctaatacactaagacaaatcaatatacctctattttgaatttgcattcatttctttcatgtatgcccctaatatttccacaattatgatgatttttgtgtttatctttctatattttatataccactagtgtcattttatgttaatttaatttccctggtcgtgaagacattataagtttataatgactgcataataatatatatatatatatacatatatattttttttttttgagacagagtctcactgtgtagcccaagctggagtgcactagagcaatctcagctcaccacgacatctgcttcagggctcaagcgattctcgtgcctcagcctccccagtagctgggactacagacaagcgccaccacgcctggctaatttttttttttttgagatgaagtctcgctcttgtcccccagactggagtgcaatgacaggatctcagctcatgcaacttccgcctccgggttcaagcaattctcctgcctcagccttctgagtagctgggattacaggtgcctgccaccatgcccagctaatttttgtatttttagtagagacagggtttcaccatgttggccaggctggtctcgaactcctgacctcacgtgatccgcccgccttggcctcccaataattttttgtattttagtagagacagggtttcaccatgtttcccagggtggtctcgaactcctgagctcaggcgatctgcccgcctcagcctcccaaaatgctgagattacaggtgtgagccactgcgcccggccacaatattatttttatcataggtactaatacatattgatttttagctaattcgaattgcttattaatatcaataaaaatatgcagatcttgttattgaagctctatggatctgtgagctcaggggagatgcctccgtgtgcagtgggaagcctcaggtgcaacatgcctggcatctcctgctcaagatagagtgcaggcagggagcttgctgggcatgtttgcaggagggagactagactgaggcatgagaaacaatctgtcacccacacccaccagtgctttcatgcctgagtcagaccagagcttttcagatgttactgtgcgcacccatcatctgagatcctgtaaagtgtgaattctgattccgtgggtctggaataggacctgactttgcatttctaaggggtcctttcccccaatttttcccatacatattttaatatcctcaaattcataagaatggtggaaaacaagaaggaaagctatgagcagacagaaaccaaagagtaatctcttgcagagagaactaaagacttttgacttaaaaatttcccagtccagggccgggcgccgtggctcatgcctataatcccagcactttgggaggccaaggcggctggatcacctgaggttaggagtttgagaccagcctgaccaacaagatgaaaccctgtctctactaagaatacaaaaactagccagctgtggtggcaggcgcctgtagtcctagctactcaggaggctgagacaggagaattgcttgaacccgggaggtggtggttgcagtgagctgagatcgtgccattgcactccagtctgggtgacggagcaagactccatctcaaaaaaaaaaaaaaaaaaaaaaaattcccagtccaggctggaagatggctagagaggacagctgagatgctgacagaggtgccactttaagaaacaaaccagaaatgaaagtaaacacaccccaaacctcgacctcccctctgactcctgttcaatctccccactggtgcctcctccagtctttgacagagtgtggaacatcctcaccctctcccattccttatctctgattcacaatttcccatcttgattctccagtctctctttcctaccgtctccttctcccctgtgacctcctcacttagtcagcaagttctctatgtccaaacagccatgggaagtttttcagatcttgtaagttgtcacttgcatccccttcctttagtgaatctctctaacccttcacttcagaaaaagccccaaggcttctgattctccagtactttctccttctactcccggggttctcctcacttgacagagaattcagtggatctatcaatcaggtgaatttgtcctccccagcactcaccagactgcttactatgtgctgatctcctgagcaaccaagtggggagagagaaacctggcttcatgagtatcctggcaagtggattcagggctgaatcgcccctgcttgtagataatgtatgcttatttcagctgcaatttgtatatgagataacccttcccttaagaactccctataaagtgagaattgtgcaccctgttcccactgaggaggcctacatagaaaactaaagactgagacatcaggcggctgccctgagggagaacctcactgtgtcattaggcagtgagtgggcaggggtcctggcctaggtggaagcaggagcctctgtgaaaaccacccctcctctagtcacagagaggatagccggtgggcctgccctgaggggacctctggggctctcagctggggaaatgaggaaacagacactgatcctggcctccgctcaggactcattgggctagcagctgagtcctccctgggaccctgcagagcctcaagccaggctgagcacaggcccacgcctcccagaaatgacacccagccacagggctgcaggaaagacccagcgaggctttggttggccaaaaatttgcatgaagggctcctgtttctccacggtctggagggtggataagaggcctgcagcatggctgcctcggcacagcactggggtatctggacagtggcatacaccctactcctcctcttcatcctcctccttcatgggacaggccaacatggtcctcggcatcctgatccctggctcactcatgatgcaactgtcccctcttctccttcctccaggatgtaatgagtttgttttcaggttccctctcccagccagggagtctcagccaagctcacctgcacactgagcagtaagcataggacctacaccactgcatggtagcatggacagggaagccccttggtgtgtgatgtggcttaagagtgatggaaaccatggcaagagggacgggatccctgatcactactcaggctccaggtctgaggctgaccactccttaaccacctctaacatccagtcccaggacaaagctgactgtatctgtggtgtatctcacagcactgcaatgccatgtgaatgaagcacagtgacccagatgaatggagatgtgggacaaaaactgttttctccactacgaaggctgccacacagctctcagaaaatgtctggtgtcataaattctaggaaatgttggcggattttttgttgttcctgttgtttccttttcaattttacaaggagtgacatagatgcattctgattcctgccaagagttccctgggaaccagtttgctacacagatcttcagtaatgctgcaaatattacaacagatcttgacacccctgctggtcattgtctctgcacgggggatgcaaggccattcactctcctcttcagatataaacactgggactcagctacatgccaccctcctaccacatcatggttcatcctaatgaccaccctttgaagataacacctttatctttttttgacaattttaaaaacaatttctatttttatcttaagattcagggggtacatgtgcagttttgttatgtgggtatactgtgtgatgctgaggcttggggaacgattgattctgttattcatgtagtgagcatagagcgcaacaggtagtttttcaacccttgccctatgtatgtttaacccagaaagtccaaatttggttttcacattttgaaactaatgtttcattcaatgtccccttttgcaactggtttctgagttgtttgtgtgtaatgttatgaatggcatgagattcggtttttggtgtggatctctggatgaaggctatcaccctttctaatctgtgcaatgccctgtgcccagttaatcatggagtgtgcatccaaaaagtacaaacacagagtgaccactgggactcaacaccttcaacctggtatcaatagaaggtctgtatctgcatcacagatgtgaatccacaacaaatccttcccatggctttgacccatttctctataccaggctctctcccaagagaatttcaacaaagaattgttttgaactcaagtcaaaaagatgcccttcaagcattgtttaagcagaactcctaccctggcataccaaccagagagcaactggccaaagaaatcggcagtctggagtctaggatacaggtgggcttgtatttccatttcatttccttggagtcaaagaaaaaagacaagctggactaagcagtctccaatcataccatgttaagaatgaactgaaaactaagacccctatctctgccttttaccaatcgtggaaaatgtggtctggtgtattcactgatggaggaaggaagttaaattgggcctttctcctggtaggaggaaattaaatcatatttgcatgctctagagaatataggtaatatggtcaccatgatcatgataagttgtcattgatacctggcaccaatattatagaatgctcagataataggtaatattgaggacggtgaggtcagggctgccataaagtcccgtttctcatcccatggtttttgtttcttttctactgttttgttttgagacagagtctcactctgtcacccaggctggagtgcagtgatgcaatctcagctcactgcaacctccacctcccaggttcaagccattctcatcccctaccctcccaagtagctgggattacaggtatgtgccacatctggctaatttttgtatttttagtagagatggggttttgccatgttggccaggctggtcttgaactcctggcctcaagtgatccccccaccttggcctcccaaagtgctggggttacaggagtgagccactgtgcctcgcctctactaagtgtttttatgtgggctttacacactggagagtttagtgcctgatcccattttggaatattttgagtggaaaaatggatataaaaataaaagtgtctgggagcggtggctcatgcctgtaatcccagcactttgggaggctgaggtgggtggatcatgaggccaggagttcaagaccagcctggccaagatggtgagaccccgtctctactaaaaacacaaaaattacccaggtatggtagtgggaccctgtggcagagaattgcttgaacccaggaggcagaggttgcagtgagctaagatcgcgccactgcactccagcctgggtaacagagcgagactgtctcaataaataaataaataaataaataataaaataaaataaaaccattctgtttctccagttaagaaatagctggaaagatcacaatcacaccaggagaagtgtatccagactgtcaacaactaagtaaaagggactctgttgaagaaaagcctacggtcagggttttatatcaaatgctataatcctgagtaagccctgggatacagggatctgagtttcaggcaggccaagtgaagacgtatttccttttctttatgcacccagtccaggtgtcagagtgctacatcaaatccaagaatgaaagtgtggcccgggctgggggcagtggttcatgttggtaatcccagcgcttttggaggttgaggcaggagttcgagaccagcctggccaacatggtgaaacctcgttactaaaaatacaaaaattagccaggcgtggtggtatctgcctgtaatcccaactactcgggaggctgagacaggagaatcacttgaacccaggaggtggaggttgcagtgagcccagatcgcaccattgcactccagcctgggcaataagagtgaaaatctgtctcaaaaaaaaaaaaaaaaaaaaaaaaagtgtgtccacgggaagacatggagattggctggagcactggcaaccagcccactggaattgatggtgccgaaggaaagcacaagaaaccatgtagaatgaggttggatccgccagggtgttcactaatgtatttgttgcccccacatttccagccatgtttaagacttctttcctgatcatatttgaagtgacatattgagagaatagatgaaacagttttacaaactgcctgggacataagagcaggtcaacaggtattgcttgtcttttaggatagaatccttattgtgagttatcaagtccccacatgaaacactaagaaatgattaaaagcacattcctggctgagcatggtggctcacgcctgtaatctcagcactttaggaggccgaggcaggtggatcacccaaggtcaggagttcaagaccagcctggccaacatggtgaaaccccgtctctacacaaaatacaaaaattagccagggcatgatggtgcatgcctgtaatcccagctactcaggaggctaaggcaggagaattgcttgaacccgggaggcagaggttgcagtgagccgagaccgcaccattgtacttcagcctgggcattgcagcgacactctgtctcaaaacaaacaaacaaaaatctgcattcctctatgccctccagtaagaaggaggcagccacagggtttgattatgacagtcacagtctattcagagttaggtttttggctcataggagtctccttatctagtactgtgtctggaatgaatgaactctggggtatatacgaatgattccaggctcagcagtaagtactggtaattagtgagctcctctttaagtgaattttgatcagaggtcccttcacatggattgtgtgttatgaaatgcctttgattatggggagatgacagagagccaaggaaagtcagtcagtccttgaccaaagcctttgtgagacctaaagagtgagagggaggcagaaagagcaagtgagcatgagacaaaaacaactgtagggtggggaagaggtgaaggaagagtggacacacacccatcggccagctctggctttaggatgctagccagtgtctcctaacccagggacctttcctttggagaccacagatgggacagagaaggaagtgattcttggtgttgagctcaaatagatacttaaaattatgtagactaaatcggataaaacttgaatcttcttttcccacttagatttggtttcaaaaccagataggacacctgaggctgagctggctgcagtgtggacgctcctcgggaggacagcagctccaaggacacgagaagcctcagccctgggccccaggtgagtccccagcagtgccagtgcacttcctcagtgcatctctttgaagtagaaacgtctctttaggctgtttccaaatttgttgcagagaatgctgatgtctcttccacagcacgccagtgttggagatgtgaccaccatccccacctcatgggaaggtagtttggaagaagggaaggccattgatcttccagtcctggtgtggcaggcagtgcagagtcctcttcttccagcactgcaagggtttaatccaaggtccaggatcagtgcatgaacacctcaggggcctgggagggagtaagcatggtgagaacaatatttgaaaatgtctgtcttagggttgatgtgaagatggcctgaaagccctcttttcttgtgttttcctacagaatgcttaaccaaaggagggagacaaaagtgatgccatcactaaaccacagacaggtgtcctccttcaagcttttcagaggaaccgattccctggaactgccatcaaggaagagctggcaaaacaaacaggcattccagaatccagaatctaggtaagttttctgtctgtggtgcacaatttgtcccataaatttggaagtggtattgcccgctgagatggtactagataaatgggagctggtatcttcaaagaagttgagagttctttgttatgagggtgctgtcatgtgtcttattcgtcttatgtcatatgtgccttatgtcttatgtgacctttatctccatcccaggcttctaggcactagacaccagtatagaccttgcccctcaactaacccccaggtgtgataatctaatagtctatggtctccacttttgtgggaaaatcttgccattctagcaaatcaatgtggcatccattcacgggccagtgcaatacttcccttaactcgtccatattttgcagactaaatgtacagacagaatcaccgagataaagcccaacagatgtcacttctgcctcacagatgagggaatgaagctggaacctcttacgtcttctgacatccttgtttccctttctcttagatgtgggctcagaactgaagagctcagcccccaggccagagcagaggcagccccgtgaattccctggcagccccagccacagaactcaccctactgctcagctgcagcacagcaacctgtgcattgcgcaagcagctctgcgcacaggcctccctccaactcccccagcagccattggtcatctgtaccagcccttcctccactaagcaggtctgtggaggctgtgtgagccaggcaccaagggccatcctgcaccagtccacctgagttgtgccaggagatctctcctctcaggacccatgtgtcaacaggaccaactcttggaggggtactctcacccacttagtctcgtttctggaatgtgtaccaaggaaattgccagaatgacaaggacagtgacagcactagcctgggagttctgcccttcaaggacactactcagcctccttctggtcatcctgagcaaggatcgcaacaacaaggtctgcaagacacagcccaccttaggcaatggtggccatgagcagccccagggtgtggtggtcaaattgccacctggggacagggtgctgctccacaacgtgctcacatggacacacctgcagcagcctagggcatggccaagcaaggggccacccctttcctttgagctttttttttttttgagacagagtttcgctctttctcccaggctggagtgcaatggcaccatctcggctcactgcaacctccacctcctgggttcaactgattctcctgcctcagcctcccgagtagctgggattacaggcacccaccaccatgtcctgctaaattttgtatttttagtagagacagggttttaccatgttggccaagctggtctcaaactcctgacctcaggcgatccacccaccttggcctcccaaagtgctgggactacaggcgtgagccattgtgcctggcctcacctcatcccttttagatgaactcctgacaacctcagagtttcagaaatcaccatcatcagttaggattaggacaggagaaccctccatggcctgcagccaggaagagtttcaggctctgctcgatgccctgcagagctcactagggcttcgggtttaggagggagaaggagtctttctcaccatcccatctggctcctcctcacgatgaagtagtagtgtgacccacaggaggataaacaaggggagacaccatgtcctgggacaagactaatgcaagaggaaactgaccacttggaaacccaaaaggagcatcttttctctgccttgtggacaccactttagtctctggcctcacttcatggcctacgtgattgtttctaagctccacactgtcctgcaggcaccacggacaccaggcagtggatacctttgctgaatcctaaggagccaaagtgtttttataatgaacacgacctccttcctgtgatcgtcacatcctgggcagtctggacaatgcacaaactagaactgaaccaaggtgaaaataggtaaaagagacacatccacacttcactacctttgatgagttcacagggtgagcctgaagacaggctaatgcagagaaaatgggggtgctatatttcatcttgatgtcggttcaccacaaagggtttgcatcttagttcttactggaggagatgggaactagaagttatctcactatctatctaccaatgattgataacaccagcttagatgcataatactgataatgaatagtgttcacatgtaatcctccctttaaacatgtagacagagaacatgacaaggaaatgcaaaacagcaactccatgaaatcactgaacaaagcaggatattcatcttctgacactgttagcattatgtatatatttacatgtaccttgctgccctttttgttataaataaattttttggcaagtttaagcctcttggttgtctttgtctgtgtctcctctcttccattcaagtggtacccatggattaccaagctatgtctgcttccattggtgccttaaaactatccttaaaaaggaaatgtgatttatcaagatggctgtctttcccacaattatttcattcatttgtgctgtctctttccatgtgaacctgtgggaccagagtcaggatgccttgctctagttcatagcttgaatctgcagatgccagtctgttattactacacacagacacagatgcattttgctttacggtttctctagggtgtgcatactccaaacccactgtttacttccagatgatcggcacaggataattttcctcagatttttttttttttttttttttgagacggagtctcgctctgtcatccaggctggagtgcagtggcaccatctcagctcactgcaagctccgcctcccaggttcacgccattctcctgcctcagcctcccgagtagctcgggctacaggtgcctgccaccacgcctggctttttgtatttttagtagagacggggtttcaccgtgttagccaggatggtctcgatctcctgacctcatgatctgcctgcctcatcctcccagagtgctgggattacaggcatgagccacagcacccagccttttgtttttcaaagagacgaagtctcactctgtcacccaggctggagtgcagtggcaccaccgtagctcactgcagccttgaattcccgggctcaatccaaccttcagattaactattaactggggtattataaatctctctcccagccccacctcacatacacataggctgcatgcaaacacacacacacagtcataatagtctcacagtttcccctgaaaataatctgacaaatgtcttaagcagcattgggaccatgccattaggtgttgagtttgattttttcagtagcctcccaacatattcctcatgtgcagagatgagagtgtagcatggccaaatgccaaatttccaagagacattttgtcttcatccatttgtgtgaaccatgtactataacaaaccacctgagactaggtcgtttataagcaatagaaatttacctctcacatctctggaggcagggaagtccaagatgaaagtgccaagatgaaaggtgagtatccagtagggacaaggtctcggcttccaaggcagcccctccttgctgtttcctcttgaggggagtgacactgggccctcacatgtcagaaaggagaggggcaaaaagggcctagtgtgttctctccagctggctcctaagatcactaatcattcatgaggtggagttctcatgaccttaccacctcccaaaggccaaacctttgcaagctgttgcactgaggattcagtttcaacatgacttgctttttgttttgttttgttttgagatggagtcttgctctcttgcccaagctggagtgcagtggcgccaacttggctcactgcaacatccgcctcctggattcaagtgattctcctgccttagcctcctgagtagctgggattacaggtgcccacaacacccagctaatttttgtatttttagtagagacggggtttcaccatattggccaggctgatcttgaactcctgacctcaagtgatcctcccgccccagcctcccaaaatgctgggacttgtgcttggcctcccaaagtgctgggatttgttcttggcttctcaaagtgctgcgatttgttgagccactgcacctggcctcaacatgacttttggaggggacacaaacactcaaagcacagtggatgtcacagtcactctccctatgataatggtaatgtcatatattctgtggctcaggtgcaggccatcaggccccgtgattccaaaattcaccctgtggcatgttggcaagtatcagtgccaggccatgctcaggcacactggcgagggttttgtattgggagagcagaagagttacttcctctggtaatctggggagaactggtacctttttctcttctcatcagcacctggaccatgggccaccatgcatgtgcatcttgacattcttaggggtcaggaaatcatgtgtagtggcagcaagtgaaggcgcagcacagggtgcaggtactacccctcctgaatgcctccttaggcaactggagtgccacactcacctctctcagttgtctcctgcctttccacaaacctcacaataggccatctgcatgcacaacccaggggtgtgcaataacaaacaatagtctatagggatgttccatgcagccagtgataatcagagagctccagccagtcctttggaaagtggggctcaagtgctgatcagtttgtgtgcagtgtggtcactacctttacaggtgggagcctcagagaccacctgccaaacaggctgagcccaagtcaagtcatgcagggatacagccaatgggagagcactcttgtcctgcacacaagagcattttaggatgggaagagatgtgacactcacctcccctaagaaaagtgcattacagcacaggccaagtgcaaacctgccagcaactggtggttctgtccaagaagcctttgccataatatggaacctgtcagttagccaagagcagttagttaaaattggactagacgaccctggctttggatgggccatcctgtttatgccagtggttgtaactgcttccttttcaccctgatggtgaagatgggattccccactctgatgctatagaaaggttgaacactgaatacccgacactggacagataagatctaggtgagtttgtcagtcacaccaactctcagaaaggtgaggaggacaccacatgccgggcagagccacaaagggttccacttgggagcaaagtggaaaagaaggggttgtagtgagcagctgtactatccagagagtacagtgaccactgtttgctgtgggaggatgtgaggggtttggtgaataattccaagagctggtagggaagcagatcttactgcttaggaataagcaggaactgtgcctggcccccctgacagggaggactgtctgctaaggtacctcacctgtggaagcagagtggggatggaaacgagtttaggtcatttgaggtccttttggcttcagatgtcaagagaaccaagaatactagtccttaatttcaggtcacagttaccataatttaaaatatatcaaggatgtataaaagcaattcaaatgttcattaacggtgatttacaggttcagtcagaaacacacgactaacaaaagaacaccttagtacagaaacaagatgttcctcagggttggttggttatttacttatttatttacttaatacacttcattttttagagcagctttagggttacagaaaaattgagcaaaaagtacagagaattctcatataaacctttaaccctcccatcctccacaggctccccaattattaacatcttgcatcattatggttcatttgttacaattgatgagccaatagtggtacactgttattaactgaagtccagagttgacactagggtttactctgtgttttccgttcactgttttccattctctgcattttgacaaattacagtaccctacagagtactttcactgtcctaaaaatcacctacctgccatccctcctttcccctcaactctcagcaaccactggtcctttgactcgctcgatagttttgcctctcccagaatgtcatataattgcaatcatacaacatagaaagccttttcagattggttttcacttaacaataagcatttagggttcctatatgtcttttaatgacttgatgtctaattcttttttatcatatacctgaggactacattctacaaccctgctataattgcttattaatgtcagcaggtttttgttatttagaattttctacaaagacaatcatgttatttgagaacaaagacagttgtatttcctccttccaaatttatgtgcattttatttcctttttttttggtatcactgcattagatagcacttccagtacaatgctgaaaagcagtggtgttccttgccatgttcctgatcttagtaggaaagcatttagttggaaacatcaaggatgatgctagatgtagggttttttgtagtagttctttatcaaattgagtaagttctcctgtattccttctgtgttgagaggttttatcatgaatggatattggattttgtcaaatgctttttctgtacctattgatatgatcatatttaatctttgaactgctaatgcatgcaatggattgcactgaatatcaaatgttgaacaaggcttgcattcctgatttgctaacattttaaggatttctgcatctgtgttcactggaaatattgatctgtagttttcctttcttgtaatgtttttgcctggctttggtattagggtaatcctggcctcacaaaatgatttgggaagtgttatccctgcttttattttctgaaagagacagtacagacttggtatcatttctaccttaagtatctcgaaaaatgcacatcagtgaatccatttggtcccggcactttttttggaaggttttattattattaattttattgagatggagtctcactctgtcacccaggctggagtacagtggcacaatcttggctcactgcaacctccacctcccaggttcaagtgattcttctgcctcagcctcctgagtagcttggactatacacgcatgccaccacgcccggctaactttttgtatttttagccaccgcgcctggtcttggaaggttattaattactgcttcaatttatttaatagatatatatgcctactgagatctaccttttatgagctttgagagaatgcatcttgcaaggaattgatccattttagctaagttatcaaatttatggacagagttgtccatatttctttctaatccttttggtgaccataggatcagctatgatggcctctttcacttttggtattagcagtatttgtcttctgttttttcttaatctagctagaggtttatcaattttacccaccttttcaaagaacagttttgggttttattgattttctcttttcaatttcactgatttttactctaatttttttccaggttactttggatttaatttgctcttctttttctagttttccaaagtggaagcttagattacttgtgtaatctagggtcaccagactgtaaaatcttagattatttgtatgatctgatcatgtaatgtagtgtacaatcttcacactgtcaataaaagccccatgccagcttgattctggctcttctccagcctcaaccctcctcttcatattctcaaaagtctctgaaggcccagatccctgtctgggtacaatgagcaatgaaatgacagtccaacagccctgggcagcaactgggctgtatgtgtgggcctctttccagggccctgtcttggagagcagctgcttaaagaaaatttggactatcacttacgctgaaggctggagtgttcacatatgtaccccaggcagttcatggcatgggatgagccacaggtagtaagagaaagggagtaacatggaggcaggcctagatcttcacacgtacaggatagattttttttcagataatctgttattttgatttataacttttaaatggataaacattagctctgtgggtctctatttaaattgtttcaggacacgacaaacacctgggatgggcctgatgaagtaaccactactaaattaggatacctacttcctattcacaattacgttaaataccattatgcatatgaaacacacgatttatatcacataccacttgtacatatgtaagtcctatgaacttcagggataattcacagatgtgcttaatgctgttgccctgattattcaatttatctatgctttacaaaaagcttcatagtcaagtggatgccagggacagggatgcagaaagggtgtggttattaatacaacaagggaactacttgaggctaaatcctgattcctttgtaatcctgaaacagtacagatctcagactccttttccattctgtaaactaattgtgttgatggttactcaaatgtaaaagtaccagtttgttataaccacacacacacacatacacgtacacacacagagtgcacgcaaaccatagcaaaatctgagtaagtctgcatctactagcaaggtaacatcgatttcttggacttgaccatatactatgattatatattatccttagaggaagcttggtgaagggtacacgggaattctctgtactcattacaacttcttgtgaggttattttaattattacttcttaaaaaattcttaaagctttacattccacaatgtacatctataaattattgttagataccttaaaaactattatggcatcaaactcaaaacagaacttgtcatattttatttctaagcaaaattttcactttagatttcttaaattgacaattttctcctcagtgtaaatgctaacataatcctatttgtagttttgccaaaaactttcacaaattcaaaaaaatctgtgaggttttatgccagtattaaccatctgatattcaacagaatatcacttcctaacaaaagccatcctatagttgttgtagtctatgggtttatcccctactgttactttggagtaacataaggcgagtttgtggatagttattgaacattcaggatgtcaacaggcccttctccacagtgtgaagactctgaggcattatggaggctgacttgtggctggaaatttctaatatccaattcattcataaggtttttctcctatgtgtgttctctgatgtacaatgagatttgacttttgagagaaggttttcctgcatgtgttacattcatagggcttttcccctgtatgtgatctctgatgtttagcaaggtctgatttacggtaaaagatttttccacattcattacactgacaagatttctctcctgtgtgagccctgtgatgtactgtgagtgatgatttgtgactgaaggatttcccacattcattgcattcatagggtttctcccccgtgtgctttctctcatgtaaaataagtcctgacttcacacagaaagattttccacattcgttacatttataaggcttttcttgtgtatgggttctctgatgtacaattagagctgacttatggcagaaagcttttccacactcattacattcatagggtttctcccctatgtgaattctctgatgctgagtgagttgtgacttctggcagaaggtttttccacattcattacattcatagggtttctcccctgtatgtgttctattatgttttgttaggtatgatttattgtaaaagatttttccacattcatgacattcatagggtttctcccccgtgtgtgttctataatgttgagagagggttgacttatggctaaagaatttcccacattcaggacatgcaaagggtttctcccctgtgtgcgttctctgatgtattgtgaggtctgacttcaagcagaaggttttcccacattcataacattcataaggtttcaaccctgtatgaattatctgatgcctggtgagtactgacttgtggtagaaagttttcccacatgcattacattcataaggtttatctcctatgtgagttctctgatgctgtgtaagatgtgacttttgacaaaaggatttcccacactcaagacattcaaaaggtttctcacctgtgtgagttctctggtgtactgtaaggtgtgaattcatacagaaggattttccacattcataacattcatagggtttctgccctgtgtgtgttctctgatgtttagtgaggtcagatttctggtaaaaagttttcccacatgcattacactgatagggtttctcccctgtatgtgttctctggtgtaatgtgagggctgacttatggctaaaggctttcccacattcattgcattcaaaaggtttctcccctgtgtgtgatctctgatgtttagtgaggtttgacttctcccagaaagtttttccacattgattacattgaaagtgtttctctcctgtgtgcaccctctgatgtcgagtgagatgtgacttctcccagaaagctttcccacattcattacattcaaagtgtttctctcctttatcacctttctgaagctgtgacagacacaatttcctcctgaaattattcccactttcaccacaatcatagtgtttcacaggtaccccatcatgtttagaaagggtggacttcacacataagaacttctcacaatcactaaattcatagtgactgtcctttgatggaggtatctgatggaacaagagggatgaactatcacagaaagttctcccaaattcattatagtcacagttattctcttctgcattctctctcttccgtgtattgaatactgccttttcaaggagggtttcctgacatatactgtattcaaaattgtggtctaaagtttgaatcttctcatgctgcaaagtgttctcacgatgactcagagtgttcctatttttcaaaacttcatttttctctcgagtatgagtttcatcatgcttaatattgagtaacaatttcccacatgcattaaattcgtcagacttttttcctaaatagtttatcttactgataaccaattctgaaacagtgttgaaactcattccacgtgagtcatactgacagaacatttttctggaaggaaaagaacttacgtccatgttaaatggtattcctattacattaccttgttccttagtcagcatttcattattgatgaatacaacttcccacaaatgtttagattgattttcttggctcctctctttcaggtgatcagctgtccagacttctacaaacaaacaaaattaatcttaccatataaataccaaaacatctcttagggaatgaaatctctacacaaatgccctatgttgtagctgactctggttttttggccaatttccagagatgaacataattgcaagtgcatatttttttgtatttcatgagtttggagtgaaaaaacaaaaacaaaaaccagaaacaaaaggcctaggctagtggaaaaacagagaggaaattaactatctgaatgcacacacttggtttctaatgtaagaagaataatagcaactgcttacatctgcatttccccatgcatctccccaagaactataaaggtcagcataagtggagcaaataatattatctataacaacccatgactttagcataactaggagatggagaatattactcatttcaaatcaccactatgcaatagatattcaaatacagcaaaaagtgacagcccatgcctacaaagagagtcagccagagactgtggtgatcacatggaatagaggagacagacagcccagagaggatgaaacacaaaactactcccagaaagggaaagttttactatgagtgagaaaatgctcagaagatgtctgaattcacatagattaaagctcaggctactgggaaatccaagagaagagacttggattgtatgtaaactaaagaggcaaagggtaatcaaactcaggaatgaagttgtaaagaggacagagtaatcacagaaaataagacttgtaattcaagtcttattaaagacttattaaagacattccttattaaggaatctgtcatggactaaactgtgccccccaaaaatgtgtatgttaaaaccccaacctccagtgtgactgtatttgaagatggggactttaaggagattaactaaggtttaatggggtcataagggtaagactaatacaatggcattcatgtccttataagaagaggaggagactggaaagcacatgcatgaactctctttctccccctgcccaccacacccgaccactggtcatatgcacagagaaaaggctgtgtaaggacaccagaagaaaatgccatctgcaaaccaaggagtgagaactcaccagaaaccaacgctgttgtcaccttgactttagaattacagcttccacaattgtgagaaaatttatttaagctacccagtctgttgaattttgttacagcagcctgagtaaagtaaaaaagagccaaaggggaaactacacttgactgaaacttgaataaacagcattgtaaaggagaatgaaacagaaaaaagagaagaaacaataattttaaaagagtaagaaaaaagaaaattggatcagaaagaaagttctggataaagctggtctacaattaaataaataaaattataatatagtatatatgttattgcagtccttaaagaagaaaaaagaaaacaatggaataaatctaatattagaaagtataatctaagaaaactgtccaaaactaaaagacctgatccatgatggttcctattcaaaagaaccatcatgaacctgggaaaactgttcagcaacagttttctctaaaacatatcttaataaaactactagatgttaaaattgaagaaaaagtactctggacaaaaagaccaagtctcagcaaacttttactttgataatgagtcttgaaatcaggtaatgttatacatatgactcagcttttatttttcaaagttttagttattgtagttcctgtgtatttccacataaggtttagaattacatactcaattactacaagaaatcctgctaattactacatggaattatattattttaaatctataagtcattttaatgacaaaacatgtcagcaatattgagctttctgacataagcagggagttccacttgtttaggtcttcaatttctctctgcagtggattattgtttctagtgtggtctttcacatcttttgccagacatagctgtaaaaaaaaatttttgatactattgcaaatagaacttttaaaaattgcaatttccaattgatcatttcttatagaagattcatttttacatatttttctcctgtcacctagctacacttaataattctagtcattctttttcccatatcttgggagactccattagatttcctacgtagataatcatatcttttgtgaataaagacatttctacttcttttccactctagtctcctttctttttcttccttggttatactagatagcatatattatactatcaggtatgagtgtacatccttgtcatgtttctgatattggaaagaaatcattccatttttcacaattatatacaatgtcaattgtacattttctatagatgacttttattaaagaaagttatcttctattcttcatttgagagttttaatcagaaatggatgctaaattttgtcaaatgctttctcgcatatgttgaaatggtcatacgggtttgactttttttctctttttttcattttaatacagggcagagatgactacataattgatggggccagtgcaaaataaaaatgtgaggtcagttactcagaatgtataaaaagaagtatagtaaaaagtaaaataaattatgcttttttcctttaacatattttactacttgtaaaatgtaataggtataatagtaacataaaacaacataaatttacaaatcacaaaaaacagttttgttgtaataaactttaaataatacaataattactaatagtttgttaatatgataccttgattgatcataagattttctggcactctttttgcaaattcatttattaagtcatcgaaatttatatttttagcaacttcattttcaatatataattgaaagtaacatgtattcttggcaaatgcaagataagtaatttttgctaatttttaattttgagaaggttgatttttcagctgatgcaatcattagggacctgttggttctttatacattgtgacaatatgggctaaatttctgatttctgatatattactgcacaataaaagttaaaaaaatacaagttttggtatatatagacaaagactggagtagcacttctctgcaattaattcttcatgaatgttagttttgtacaaaactgaattcaattttacatataaatttatacaatggcattttaatgtttcctctgacatttcctacatcttgtacaagaaaccaaaaatggcttcatgatttgcatataattggaaacacctgtttatgcagtatattgctgtattttcaaatgcaaaaaaaaccctatttttaaagttgacttctttgttaatacttgattcatccaaaattttaaatgaaaataatgttctctcccatcaaatgaaattcctatttctaagcctgtggatatttgctttgcaatgttgcagcagttcttaacaccagagaatctacactccaaagaattctagtaactgcctagtgtgccttaacacaatgtccacaagtatgcttttattttctaatactttactgaccatgatgactgcctgaaagctggaggttactgtcccagtactcagcccagaaaattagtatttcctaagaatggcagagggacagacttaggggagagacaaaccagcctcacgctgtgggtcctctctgggttgcaaatgttcatgagtttgctgctgctgcaaccaatgcagacaaaggtcatggccttggccacccacacacaattccagaacactcccaggccatactacacagaccaacagcttagtagggcactgcctctcaagtatcctgtctacttgcacacatagtccagtgtccatcagacttcacatacaaatcacgagttcaaagataaaactgtgaagaacttcaagatggcaacagcagggcattaagtgaagtacaggatcccttcttacaagagtgtagcaacgtgtgactgcacaggtcacctagccatgaagttggccgagatacagggaattacactgactgcttttcaaatgttgaaaaagcctgccagggattaaccacacttggtcatgaggtattaataaccttgttatataccactggtttctaatcactagtgtttttgaatttatgttcatgaaggacactggtctacagctttctttccttgcaatgtctctgtctggttttgttattagggcaatgctggactcaaagaatgatttaggaagtattccctcttcttgaattttctggaaaagtctttataaattggtactattaattgtttgctggaattcactactgaagcatctagggacctggggttttctttgtggaaaggttatctatttgttttggagcaagccgtaatagctgtttatttgaatgaaactgttcatttcatcaaaatcgtcaaactgataatttacaggtatagtattccctcacttccttcataatatctatagaatcttcagtgatacatcattcttatttttgatattgataatctgttccacctagaagtttatccattttatcgatcttctcaatgaaacagcttttggtttcaccgattttctcaactgtttttctggttctacagattatattgttctccattttgttttttattatttcctttcttctactattatatggatttgtcttcttttctacattctcaaagtggaattagctaagaccattgatttagacctttcttcttatccaacacaagttaaacttcatacatgtgtatattacatatatacatatgtatattacatatatacatatgtataaatgcatacacatgaaattccctctatgtgaaatttacacattatatatttaatatatattacacataatacattatatcccatatatgacaaacgtcatatatgcatttacatattgtggaaacttcatatatgcatttacatatggtggatatatatgcacacaatacaaacacacacaatgcttatttgtgtcgcataagaaagatctcaaatcaatgacctcaggtgcttctaccttaaaaagctacaaaaaagcaaattaaacccaaaagtaagtagcaaaaaggactaaggatcaaaatggaaaacaatgaaatcaatgagtattgtatgtattttatatttcctatgaatttcctatatgtaaatttcccataaattccattttcattaacccaaagttcaaaacactttctaatttcctcttcgaattcttctttgaagcatccattacatagacttatattcagtttccaactattagggatttaatagatacttctgttattgatgtttaatttaactaaatttaaaccccttatggtgggagaaaatactctatatgacttcaatccttttatatttattaagatttgctttacaatcaggatgtgatttacctttgttaatatattcgttcatctgcccttgaaaagaatgtatattccactgttttatttggggaggagtgtgcagaagaatattttataaatgtcaattaagttatttagggttaagtctattatatctttgctccttttccatttcctgttttattaattattaaaaggatgctaaagcctctgattataactgtggatctatttctccttccagatctatcagattttgcttcaaatattttgcaaatctgttactaagtttaggattgttaaatcctcttgatgaaatgatctctatcaatatgaaaaaaaatctttatcactggtattcctggctctgaaagctacttcatctggctgtcacagcactgcagccttgtgaataattttaccattctacatcttttcccattctttttgtttatctatttgtctttgaatctaacatgtttcctttataggcagcatgattggatcttatttttatttatcttatccagaaatctctgcctttaaatggggtgttatataccatttatattttctgtgatcatcaatgtttataaaagctttaatcagtgtacttttcagtaacagtatatatatgaatcttccaatagtatatactttacttctttttcatagccttttcaggctgtgattgtcatgtattttcaatatatgttataaaccccacaatacatttgatgttatttttgtataaagtcaatatcctttttagagacttacataaagaaaaatatcttgtatacatatccaagtagtcaacatttcctgttcttcatccccctgagtagatccagatttccatcagacatcagaacatgtcttgtgatgcaggtctgctggagaggaaatctttcagctttgtttaactggaatgtccttatttcttcactgtttcttatagctatttttaccaagtatataactctacattgagatttttgcttttaaaaccaaaaataatgttctactattttctctgttgcctcatttaaggagaaatctgttatcatccttgcctttgttcctccataaaacatgtcctttatctctggctgctttgaggacttcattttaacactgatttagagcattctggttatgattcatgtggcttggtgtagttttcttcatgcctcttgtgctcagggtttgacgagcttcttagatcggtaggttcccaacacatttggaaattttttcattattctcaaaatactgttttctgttcttttcccactttccttttagagactccaattccatgtgtgttaagagactacctgaagtcctgaagttctcctaaagctcacatgggcttgtttttttttttttttttttttttttgagacacagtctcactgtcaccaggctggagtgcagtggtgcaatctcagcctcactgcaacttctgcctcccatgttcaggtgattctcctgcctcagcctcctgagtagctgggactacaggtgcctgccaccacacccggctaatttttgtatttttagtagagacagggttttgccacgttcgccaagatagtctggatcccttgatctcgtgatccacccaccttggcttctcaaagtgctgggattacaggcatgagccactgcaactggcccaagggcttgcttatttttcaaatatgctttttctctgtttcatttgtatggcttctattactgtgtttttaagttcaataatcttattcttctgcaatctttgaactgccattaattcttgctctatgtgatattcttttttttttttttttttttttggggggagacagggtctcactccatcacccaggctgcagtgcagaggtgcaatcttggctcactgaaacacccacctcccaaggctcaagtgatcctcccacctcagcctcccaagtagctaggacaacaggcatgcaccaccacacccagctaatttttttgttgtttcatttttggtacagatgaggtttcatcatgttgcccaggctggtctcgaactcctgagctcaggagatccacctgccttggcctcccaaagtgctggcattacaggtgtgagacaccaatgactggccatgtatttttcatctcaagcattatagttttcatttctggaaatctgatttctatcttttctgttacactgaattttgatttgtttttttttttttaatcttctgtgtctctacttaagttttagaacatatggaaccaaattatagcactgttttcaatgaacctgtcagttaattctaatatctatggcaattctgagtccatttcaatttcctggttagtctctttgagaaagctcatgttttcccatatgtctgtaagtctggaaatatttcaatggatggaagactgagagttttacttggttggatgctgggtacttttggcttcctataagtatttttgtgctttgttctaggatgcacttaagtcacttggaaacaatgtgacactttcaggtcttgcttttatgatttcttaggcaaatctggagcagtgctcagtttggggcacattactcctcaccacggagaaaagacctttctgaacactctacccaatactctgaattatgagtttttccacgctggctggcaggatcagtccttctccaggccctatgtgagtactgtgtactgttccctctgattcttttcaaaagttatttcactcatttcctcatatacatgagctgattagtactttgctgaacattcatggaggcccctttacagatctccaggcctctctctgtgtgcatctatctcctgcaagccaccagtgctcctcaacccccacagcttcaaattctaggaaagaactgccaaaaggccttgagccagcttcctccaccaccccaattaaaatatccagcccagtcatggcagtctgagaatagtggagtacaatgcctacctaggtcattgagaagagattccaaaagaaaccaagaagaccagagactactgccccaatccagatccctgatcataaagcacagtatcacccacccagagaaaagcaaaacactgctgtagcctccagatcccgaataatggagcaggactctcacctagggccagctgtaaggacagagagttccaaaactctcctccagaaaactcactttgttcagaacagagtttgggtgagtgcaagcctaagatcaccctcaaaaagaatggaaattcaatgataaccaattaagaagagggtagcagttctatgacagcaacaagctaaaccacagaccaactgaaagtttactggagagagcaagggaaagagatgcctaagaagagacatccagggcaattagatgtcttcctatctaccagaaacactcatacaaatacatacacagattttccacagtcatgatttttaaatttatgttttctaggaggtgactttcagaatggcaacataaaaagcaaactcaaagcctcaaagacagccctctagaaggaacccaaatttaacaagagcaaactaagagcaacatatggtccaggacagtgttgaaaacaatagagcaatatgtcagcaatcagtagcggctatcagcaaagtgtaacagcaacagaggcagacaggctaacacagcaatcacagaaagattcactcaaagagagcactgttaacaccactgccatgctaaagatagtgtgcatttctaaggcagggccctctgacaagcatcatcagtgagaacccaatgggagtgaaaaagcttctctcaaatagtagtcaagttgcctaaataaataagaaacaacaacaagccctagagagaatagaggaatcagtatctagagaaagtacaaagtattctctacaatgtctattcttcaacaaaaaaattacaacacatacaaagaaacaggagactgtcatctatatacaggaaaaatggcaggcaacagcaactgcccttgagaagatccagatatcagacttagctgacctcaaagcacttattttaaatatgttcaggccaggtgcagtggctcacgcctgtaatcccaatactttgggaggttgaggcaggtggatcacctgaggtcaggagttcaagaccaacctggccaacatggtaaaaccctgtctctactaaaaatacaaaaattagctgggtgtggtggccagcacttgtaatcccagctactctggaggctgaggcaagagaatggcttgaacctgggaggcagaggttgcagtgagctgacatcatgcctctgaactccagcctgggtgacacagcaagactgtatcaaaattaaaaataaaaataaaaataaatatgttcataaggaaacactatttagaaaagggaggtatgatgatgtctcatcaaacagaaaaatattagtaagaagacagaaaagaatacaatgaaaattctggattcaaaaattataactgcaatggaaaactcactagaatgactcaacaaaagacttggccaggtggggtggctcacgcctgtaatcccagcactctgggaggccaaggcaagcaaatcacctgacgtctaggagttcgagaccagcctgaccaacatggtgaaaccccggggtctctactaaaaatacaaaaaagttagctgagtgtggtagtgcacatacctataatcccagctactctggaggctgaggcaggagaatcgcttgaccccatgaggcagaggttgcagcgagatgagatagtgccactgcactccagcttgggcaacaagagtgaaatttcatctcaaaaaaaaaaaaagaaagaaaagagaggttgtagctggcaaaataatcagtaaacttgaagatggatcaatagagattaagtaatctgaagaacagagagaaataagagtgaggaaaaatgaagaaaccctcaaaaaatgaggaataccattaactacaccaatatattcataatagaagtaccagaaggaggggaaaaatatcaagtagcagaaaaaatattcaaacgaatggctatgctcaccttgcaacacatacactaaaactggaacaataccaagaagattagcacagtagctacacaagaaagacagagaagttcatgaagtgctgcattaaatttaaaaaaaaaaaaaaaaaaagaggccaaaaacttgcaaatctgttgacgaagagaaaatcctgaaagcatcaagagaaatacaactcctcacatgaagggaatgtcctaagattaacatatgacttctcttcagagacagtagaggccagaaggaggcaggatgacatattcagtgtactgaaaaaaaatttttgttaataacttgtcacctaaaatagcagaactatttgcaaaacagagggtgaaaatttaaaatcctcaaattaaaaaacaaatagaaaccaaaaaaacttgagaatccattgctagtagactaacaataaaagaaagaaaagaagttctttagggtgaaaacaagtgactccaaacactagatcaaatccacaattattgtgggtaaaggcaatgatacgagagagtaaaaaaggcacactttttctcctttcttttcctacccaatttaataagcaaatatgtataagtcaatgtttataattgtattgttggacctataacatatagaaatgcaatatatttaacaataaggcaggctaggcatggtggctcacgccagtaatcccaacactttgggaggctgaagcaggagaatcacttaaacccaggagttcaagatcagcttaggcaacatactgagaccctatctctaaaaaaaaatgtgtttaattacccgggcatagtggcacacacctatagtctcagctactcaggaggctgaggtgggagtattgtttgagtccaggaggttgaggctgcaatgagctgcgattctaccactgcactccagcctcaaggactcagagagaccctgtttcaaaaaaaagaaatacattgataaacaaggaaacaaataataaagcaaaaaaaaaaaaagaataaagcaaaaaaaataagcagagcagctgggtgtggtggctcatgcctgtaatcccagcacttcgggaggccaaggcgggcagatcatctgtggtcaggggttcgtgaccagcctagctaacatgatgaaaccccatctctactaaaaacacaaaaattagctgggtgtggtggcgcatgcctgtaatcctagcaactcgggaggctgagacagaagaatcacttgaacccaggagacaggggttacagtgagcccagatcgtgccactgcactccagcctgggcaacaaagcgagactccatctcagggggaaaaaaaataggtacagatctgtactggagtaaggaaattacactagatgttaagtctgaatccacacaaacaaatgaattaaagcagaaatgaagaataaggttagtataccaaactctacaaatagatacttcctatctttctttcagcttctttaaaagacatcaacacatgaacacagggaggggaacaacacacactggggcctattgaggggttgggggcaaggggaagaaacttaagaggatgggtcaaccaccatggcacacatatacctatgtaacaaacctccatgttctgcacatgtatcacagaacttaaagtaaaaaaaaaaaaaaaagacatcaaatgacataaagttacaattacaggttgagtatctcttatctgaaatgcttggcatcaaaagtgtttctgactttagagttttttccaaattttggaatatttacattatacttactggttgagcttcccaaatccagaaatctaaaatctgaaatgctccaacaagcatttcctttgagcatgttgagcatgttggcactcagtttcagattttggagcatttgagattttcagatttgggatgctcagcctgtataacaatgtattgttgggttttaaatatatatgcaatatatataaaaataacaaatggagaagaggaaatagagctatatataggtaatgtttctgtattttactagagttaaggtagtagaaatctgaagtagattttgataaggtaagatttattaggtaagttctagagcaaccactaggtaaataaattttcaaagagacatagtaattttaaaaattaaaacgttatactaaaatatattcatttcacgttgtgtacacataaacaaacatagagagtggaatgagagacactggagacttggaggggtggggaggtgggtgaaggataagaaattacctgatgggtgcaatgtatactattatgctgatggccacactaaaagcccagacttcatctctatgtgatatgtctgggtaacaaaactgcacttgtaccctcaaaacctataaaaataataaaatatattcatgtcatgtaaaagaaagcagaaataaaaggaatagagtatcaaaaaagcacgagaccgaaaacaaaaatggcagaggtaaatccaactacagatgctccttgacttatgatcaagttacatcctgataatagtcaaattagttgaaaatattgtttttccacttaaaatgggaacacattctagtaaagtcagaaaaaatagttaagttgaacctttgtaaatcctgaaaatacaaaggggtttcaaacccaataaacccattgaaaagttaaaaaatcataagtcaaaccattgtaagtcaggaaccatctgtatagcaataacgacaggaaaaagggaatgatttgaaaatccaatcaaaaagcaacaattctcaggttgttgaaagtgtgaaagtccaaacatgtgctatctataagagatagatacaaacaggttgaaaatttgaaaacagaaaaagatatatcaggcacatggcaccaataaggctggagtagctatcctaatatcacacaaaatacactttaacacaaaaattttactaaggataaagaggggaattttattaatataacaataaaagggtcaatcgataaaggagacataacaattctaagcatatatactactaacagagcctcaaagtacgcgtagcaaaaactgacagaattaaaagaaaaaatacacaagtctatgatactaattgcaaactgtaataacccattttcaataatggttaggacaactgggcacaatataaacatggaaacagaagatatagatgacactctaaagcaaccagatctaagagatatagacagaacattccacttgaaaacagtggaacaggtattctttaaaagtacacatgaaacattccccagaataaatttaaaacgattctctgaccacagtggaaattacaaatcagtaagacaaaggaattttgagaatgcacaaacatgcacaaattatataatacattccaaagttaaaaaaaaagtcaaagaagcaataagaaggcaaattagaaaaaatgctatgaggtaaaaatgaagacatactcaaacttatggaacacagataaagcaatgcttagagagagatttgtagctgtaataaccatattaaaaaagatctcaaatcaataaactaattttccaccttaaaacactggacaggagcagcaatacaaactcaaagcaagaagaaggcaggaaggaaagcagaaagattatagagtaaaaattagtgaactagagaacagaaaaatagcagattcctggaaaagatcaacaaaatatacaaacctctaattagactgacaatggaaaaaaaaaaaaagaagattcaaattactaaatgtagggattaacgatgtattactagtactcttacagaaataaaaataattacaaagaatggtatgaacaatgtatgtcaacaaattatttaacttcaacaaaatggaaaaatccataaaacaaaaacgactaaaaccaactcaagaagaaaaagaaaaatctgaaatgacctacacaagtaaaaagattgaagttgtaaatttaaaactcgccattacaggtgggatgcagtggctcatgcctgtaatcctacaactttgggaggccaaggcaggcagatcacttgaactcaggagtttgagaccagcccaggcaacatggtgaaaccccctctctataaaaaaattacaaaaaattagctgcatgtggtggcatatgcctgtagtcccagctacttgggaggctgaggtgggaaaattgcctgagcctgggaagtcaggctgcagtgagccatgactgcaccactgcactccagcctgggcaatatagtgaggctctgtctcaaaaaagacaaaaaacaaacaagaaaacttcccattacaaaaacaaaaacaaaacccaggtccatatggttcactggagaattttatcaaacatttaaaaagaagtatcaattactcaaaaactccaagaaaataagaagaaacacttgccagctcattctatgatcccattactaccctggtaccaaaatcagacatgaaaaaactacaaatgcatgtgtcatgattacagacctataaatcctcaacaaaatactagcaaatttcatctagtagtatataaaaaggattacatacaatgatcaaaggggatttatactagtaaggcaagtttggtttatcatttgaaaatcaactaatacatcacataagcagaaaagaaacaataaccacatgatcatctcagtatacagagaaaaagcatttaacacaatccaatgcccatcttctctataaaaacaatcaacaaaccaggaatacagttaaacttcctgagcctgattaaaggcatctacaaaaagtccaccactaacatcatactaaataatgaaaggtacaatgattttactctaagaacaaaaacaagataagaatgccttcttgccagttacacatcacacagcagattgtagtcaacacaagcaaggggaaggggaattcagattgaaaaaaaaaagtggaactatatgtatttgcagttgactgctcatgcatatagagaatcttaaagaatctactaaaacactattaaaactaataaaagagttcaacaatgttgtagggtgcaagttcactaacaacaaacaaatcataaatgaaattttaaaaagaattccggccaggcataatggctcaagcctgtaatcccagcactttggaatgccgaggtggctggatcacctgatgtcaggaggttgagaccagcccggccaacatggtgaaaccctgtctctactaaaaatacaaaaaagttagccaggcatgatggcatgtgcctgtagtcctagctacttgggaggctgagacagcagaatcgcttgaatcccagaagcagaggttgcagtgagccaagatcgcgccattgcactccaccctgggcaataagagcaaaactctgtttcaataaataaataaataagtaaattccatttacaatagcatcaaaaagaataaaatacttgtaactttaatcaaggaaatacagagcttgtagtctgaaaaccacaaaacaatgatggaagtaattaaagacagcctaaataaatggaaaggcactgaattgcattcatatggttaagatggcaataactgccaaattaatatctaaattcaacacaatccttaccaaaatcccatctgcctttttgaggaaactaacaagctggtctaaaatttcatgtggaaatttagggagctgaatataatcaaaacaatctttaaaaagaagtagaaagttagaagacatacacttctcaatttgaaaatttgctacaaaattacaataatcaagatggcatgatagtggcatagaggtaaacatgtgaaataaaattgagaattcataaataaacactacaatatattatgttcagttaattttcaacaatgatgccaagaaaacttaatgctgaaaaatcccctttttggctggtcgtggtagctcacgcctgtaatcctagcaatttgggaggctgaggcaggcagatcacaaggtcaggagttcgagcctggccaatatggtgaaatcccatctctactaaaaatacaaaaaaaattagccaagtgtggtggcacatgcctgtaatcctagctacttgggaggctgaggcaggagaaatgcttgaacctggggggcagaagttgcagtgagccaagatcatgccactgcactccagcctgggtgacggagtgagactccgtctcaaaaaaaaaagagaaaaaagaaaaatcaccttttcaagaaatgatgctgagacaactgaatatttgtatgaaaaacaaccaaaattattcctttcctcacaccatatacaaaaactaactgaaaatggatcacaggtctacatttaaaagccattacttaaagaaaatataggagtggatcttcatgccctagggatagacaaagcccttttagataaagtaccaaaaatacaagcaacaaaagaaaaaacaaattagacttcatggaatgaaaaactcttttgctaccaagtacaaagtaaagacaacaaaatgccaacccacaaatgggagaaaaatactggctaataatatatgtaattagcaacttgtacacagaatatgtaaaacactcttacaactcaacaataaaaggacacataacacaactacataatgaaaaaaggaattgatttttctctattaagcttctatcctccaacttggctataaagacttaacagttttgggagttctttagaattttctccttaggcaatcatgcctgtacaaacacagaaagttttatttcttcctttcccatctgtatgcctcttattttgttgtcttatggcattacctacaatttccaatgagatgttgagtaagagtgaagagacaggacatcttgtttccttatcttagggagaaagtatccagtgtctcaccactaagtatgatcttagcagtaggtttcctgcagattttttttttttatcaagttgaggaagttcttctctattcctagtttgctgagttttatcatgaatgggtgttgaatgcttcttgtccatcaattgacatgatacagttttcttctgtagcctgttgacgtggcaggttacagaagttgattttttttttttttttttttgagacagagtcttgctctgtcaccaagtctgaagtgcagtgatgcaatctcagctcactgcaacctctgcgttccaggttctaagcgattctcctgcctcagccttcagaggagctgggaatacaggcgtgcttcaccacgcccagcttatttggtatttttaatagagacagggttttaccacgttggccaggctggtctcgaactcctcacatcaggtgatccattcacctcagcatcccaaagtgctgggattacaggcgtaatccactgcacccagccagattaattgattttcaaactctgaccagccttgagtggtcatggcatctaattatttttataagatgttgtattctacttggatttttgcatctacattcataagggatattagtgtgcggtttttcttcttcacaaggtcttcatatgcttttaggattagagaaaaaatagccttttaaaaaagtgttaggaaggttccctttgcatctcttttctgaaagacactgtagagaactggtatatttcttccttaaatattgcacagaaatcaccaatgaaaccaaaagagtctgataatttattttctttctttcttttctgaaagctttatggattcaatttatttaactgatattggtccatttgaatggtttatttcttctgtgtaagtcttggcagtttgtgtatttcaaggaattacccatttcacctaagtcatgggttaagaagaagccaggaataaaggcatcctgtaccaaaaccatctaattgcattacaaatgcaaaaaatagtatcaatgaaggacccccttcaatgcaggaggaagtcttgaccttaattgctttggaaagagatagaagtctgtgagactaaaggcaggtctgcacataagtactatattttagttgataaaattataaaattattttccacatgggtatgattaacaattctggcagtgctatacatgtatacagggaaagaataatgaaggtaaatggaaggccaggcatggtggctctcacctttaatcccagcactttgggaggccgaggtgggtggactacctaaaagatcaggagttcgtgaccagcctgtacaacatggcaaaatcccatctctactaaaaacacaaaaattggctgggcatggtggtaagcacctgtagccccagctacttgggaagctgaagcaggagaaatacctgaacccaggaggcagaagttgccatgagccaagatcacaccactgcactccaacctgggtgacagagcgagactctctctcaaaaaaaaaaaaaaggaaagaaactaaatagatgatggatagttagagccagatttcttactgttgggtatggcaatttacactgaagcaagggaagaaagctaaaatgatccatgtggtaataaagagttgaaggtttaagtataaacacatgtttagcttaagagagatacagatggttacatgtagaactatataagtaagtatattacatggtttatgcacatgtgtgtttccctgttctgtcagctgagacagccacaccctactgctgtaagcacaccattagcccctatcttggtttctaataccattctcaaataaaaggaaacagggttacctgaagaaatggtgactgatttcagaaaggaaatatataagataagcctggaccatcttgcagtgacagaaagaaagtgctctaaaaaacaacagcaacaaaattcataaatctccacttcttacgtgtgagttgtgcagagtaacattgttccgatgtgtacaatatggaaaataggaagaagatgtaactttatagtggacaaactgtatgtttgccaagacatttaaggccaacatcaaaagtcataaaacatggtgacagtatgcatgcttgatataatgtgacaaaaaaggtactttactactgtggcctttttccccaaaatctataattccagtcttatcttgagaaaaacattagatacattccaataagtggaatttatatatacctcaccaggattcctccaaactgtcaaggtcatccaaaacaaggaaagtctgggaaaccaccatagccaagaggagcctaaagagacataacaactaaatgtaatatggtgccctggaagggatcctggaacaaagaaggacattaggtaaaaatcagcagacactaaataaaaatatggactttagtcaataatcatgtaccaatgttggttcaacagctgttgcaaacataccaccctaatatgttaataacagcagaaactgggttaatggcaattctctctactacctccccaatttttctgtaagtcatgaaataaagtgaatgttttaaatagacaaaggagatacataaatagccaacaggtgcataaaaagatgttcaacatcagtccgggagcagtggctcacacctgtaatcccagcactttaggaggccaaggcgggtggatcatgaggtcaggagttcaagaccagcctggccaacatggtgaaaccccatctccacaaaaaatacaaaaattagccaggcgtggtggtgggcacctgtaatcccagctactcaggaggctgaggcagagaattgcttgaacccaggagacagaggctgcagtgagctgagatcgtgccactgtaccccagcctgggcaacagagcgagattccatctcaaaaagaaaaaaaaaaagacattcaacatcattagccattaggaaatgcaaaaaaccacaatgagatacctctttacaactactggattggtataataaataataacaataatattaataaaaagtgttggcaaactggagaaactggaaaattcatgcattgctggcaggactgtaaagtactgtggctactatgagaaacaatcaggcagttcccaagaaagttaaacacagagacaccatataaccagcattctacttctaagtatatatctgaaatgactgaaaatacatgtccatgtgaaaacttatacatgaacaattacagcagaattattcataatagtcaagaagtagaactaaaaccaaatgtccatccactgacaaatggatacataaaatgtagtatacctatataccatgttatatggtaataaaaaacaagtgaaatattgatacatgctacaacatggatgaaccttgaatatgttatgctaagaaaaagcagccaggcagaaaaggtcacatgcagtcccatttttatgaaacatccagattaggcaaatccacacagacagaaaattcaattttggttgccaagggctacaggaaaggggaaagagaaagtaattgctaatggatattggctttgtttcagggatgatgacaatgttctaagaaacattgtcggctgggtgcagtgcctcacgcctataatcctggcactttgagaggcctatgcaggcagatcacttgaggtcaggagttccagaccagcctggccaacacagtgaaaccctgtctctactaaaaatacaaaaaattatctgggcatagtggtgcatgcctgcaatcccagctactcgggaggctgtggcaggagaatcgcttgaacccaggaggtggaagctgcagtgagccgagatcacgccactgcactccagcctgagagacaagagtaagattctgcctcaaaaaaacaattgtcggctgggtgcggtggcttacgcctgtaatctcagcactttgggaggctgaggtgcgtggataatctgaggtcaggagttttgagaccagcctggccaacatggtgaaaatataaaatcagctgggtgtgggggcatgcaactgtaatcccagctactcaggaggctgtgtaatcccagctactcaggagactaaggcaggagaattggcttgaatccgggaggcagaggttgcagtgagctgagaccatgccactgcactccagcctgggtgacagagtgaaactccatattaaaaaaaaataaaaaaatttgtcaggaaggttgcacaatcctgcaaatacactaacagtgattgatttatacacataaaattggtgaagagtacagtatgtgaattatatctcatataattctccagaaaattgtttcttatatacctgttttgtggtgtataaataacacaactgatatgcattgttcttacagccaaccacctcactaatttttttagtaatttaaatcacttctatgtaacatttacttttgcttgtacagataatcaaatcgtctgcacacaaaatgaaaatttgacttcccaacctttatgttttattatttttttcttgtctgtgtaatggacagtagatcctctatgtgattctgtaaaactggtgatacaagagatccagcatctctcatatagaaagtgtgctatgatttttcaacaaatagtgtacaatatgtttttgtccattacatttattttattttttgagatggagtctcgctctgtcgccaggctggagtgtcgtggcaccatttcggctcactgcaacctccgcctcccggattcaagcaattctcctgcctcagcctcctgagtagctgggactacaggtgcgcaccatcatgcccggctaattttttgtattttagtagagacggggtttcaccatgttggccaggatggtctccatctcctgacctcgtgatctgcacacctcagcctcccaaagtgctgggattacaggcatgaaccaacgcacccagcctgtctattatctttattaaagattaagaagctgaattatttatagttggtaagcaatttacaaaactttttatttgaagaaaattgttcattttttctctttttttttttttttttttttttttttttgaggcaaggtctcactctgtcacccaggctggagtcaaatggtgccatcacagcttactgcagccttgacctcctgggcttaagcgatcctcccacctcagcttcccaagtagctgggaccacaggcacgcaccaccacacctggctaatgtctttactttttgtagagatggggtttcaccatgttgcccaggttggtctcaaactcctgagctcaagtgatccacccaccttggcctcccaaagtgttgaaattacaggcatttgccaccgcacccagcctggaggcaattcttgaattgacatgcagctggaagaaataatgagaagattctgtatacccctcacccagttttctccatggtaacaatttgcagaactacagtccaatatcaaccaaaaactgacattgattcattcaatcaatcttattcagatttcacaagtttcacatgcattagttgtgtatatttagttctataaattttgccacaggtatagatttttgtgaaaatcacaacactggggatacagaacagtcccatcaccaggatcccacacatggtaactacagccatctcccaccctctctgccttcctaacgctggcaaccacgaatctgttctccatctctatgctgtcatttcaaaactgttacacaaataacagatcatgaggtattatgataaacagcctaactgcatttgtgataattggctaatagatttcaaatcccacccatctcccctcttaccctacatttgggcaagccaataataaagcctaggtggtccctccctcaatgccagtaggaaactgaaaccacacaaactccatcctttttgtgtgtgctcaccctaccccaaattcctaatgacaagcagccattcttctcccttctttctcaatccacatttagacctgcttaggagccttctctggtctccctagaaacctgtgtgtataagtaataaactcttttttacactcttgatatcattaccagttttgatacctaaaccaagcgtagggggcaggagggttcatcccaactctatggggtggaccagaacaaacatgtaaatttttgagattgggttttttaaaactcagcttaatctcttgagattcatccataatgttacatgtattagtcattcattccattttaatactgggtaacacttcatggtatggacacactacacattatttatccattcaagaacatctggattattcgggtttgggctatgacccataaaactgctataaaatttttttgatggaacattaagtttttatttctcaaggataaatgtctaacagtgtaactagtggttcacatgctaagtttgtttttagttttaaatggaactgacaaactattttctagaatgactgtagcattttacttaccatcaaaaatgtatgaataattcagtttctctaaatcttcaccagcacttgtattatcacttttataaggcaggtcaaataagagcatgataaaaacatctttcattatgacgtgtctgggtataagtctctttgcatttatcctcctatgagtttgctgagcttcttggatgaatatattagttttcttcaacaaattatgggcgtttctgcgaattcttcaaaaaatttttctttccctttctattctctcatattgatactcccgtttgtgtatgctggtgcacctaatgatatccgtttcccaaggttttgttcatttttcattattttactggctcttcctcaaattacacaatatacattgatctgcaccagacaacccagtttctgccaactaaaatggcagttattattgtgttgcctattgatagtcctgtgcatgggtcacatttttcctgtttctttgcatatctcattttgttgttgttctcgaatggacaactggtccattcacttaacagtgttgagtgacataatcaaatggtggagtacacagctcccaactgtccccacacagaaacaccaaaaaaaaaaaaagaactataaaaaccaaccttgttagaactctggaaaataattaaaggtttacagtaaccaagtgaatgctaaatcaggaaaaaggcgacttcaaatggtgggaaagttttgtggcatttttactttacaagagaccctcattaatatcaggagctcatatctccgcagaaatcaattgaaggcctgaagacagatggatgacatatataaattcctgaaagaaaaacactatcatctgagaattctctagctggtaaaactgtccttcaaaatgaaagagaaatgaagataatcccagataaacaaatgctgagtttgttactactaggcctgctatacagggaacactaaaaggtgtctttcaagatgaaataaaaagaaactagactcaaatctggaggaaaaaataaagacttccaataaagttaactatatagacaaatataaaagccagggtcattatgtttgctttgtaactccatttttttacttcctgcaggacttaaaagacaaatggataagaactaaatataaatttacattatgggcacacaatgtataaagacataatctgtgacaacataaaggggatgagtaaggtgctaggtagaagcaaggttttcatatgatattgaagttatgagggaatcaatttaaactagattgtcatgaatttagaaagtgaaagtaatcctcatgtttaattacaaagacaatatcttaaaaatgtacacagaaggaaatgagaagggaataatatataatataaaataataaaaatataaaaatcaggccaggtgtggtcggctcatgcctgtaatctcaagcactttgggaggccgaaatgggtggatcacttgaagccaggagttcaagacgagcctggccaacatggcaaaacaccatctctactaaagacacaaaaattagctgggtgtggtggcacgtgcctgtagtcccagctacttgggaggctgcggcatgagaattgcttgaacccaggaggaggaggttgcagtgaaccaagatcataccactacactctggcctgggcaacagagcaagactttggtcttgaaaaaaaaaaaaaaaaatgaaacacaaagaaggcagtaataaagggaatatgggaccaaagaaggtatacaatatacagaaaacaaaatgcaatatggcagaagtgtttccttgttggtgattactttaaatgataattgcttgaactcaccaatcagaagacagaggctggcagaatggatttgattgatttatttattttttagacagggtcttgctctgtcacccaggctggagtgcagtgacacaaacaggactcaatgcacccttgacttcctgggctcaagggatcctcctgcctcagcctcccaagtagctggaaccacagcgcacaccaccacacccaactatttttttttttttaattttttttgtagaaacggagtctcactttgtagaccaggctggtctccaaggcctgggctcaagagatcctcccaaagtgctgggattacaggtgtcaaccacccagcttcagaatagatttttttaaaatatgatcaaactacacattgtctaaaacaaactgacttaaaatccaaagacacaaataaattaaaactgaaaggctgataaaagatattccatgaaaatagccaccaaaagagaactggggtggctatactaatttcactcaaaatagattaagtcataagctgttacaagagacaaagaaggatactatatatgaataaagggtcgttccatcaataagatataaaaattataactatatatgtaccaagcagcatcctgaaacatgtaaagcaaacacagaatgcaagggagaaactgacagttcttacagttaatagttttagactgaggctgggcatggtagatagcacctgtaatcccagaggtttgggaagccaaggtggatcacttgatgccaggagtccaagaccagcatgagcaacatagtgagaccctgtttccaccaaaaaaaaaaaaaaaaaagatagctgggcatagtgggcatggtggtatacagctatagccccctcaggaggatgagtggggaggatcacttgagcctgggagttcgaggctacagtgagccataattgtgccactgcactccagtctgggcaacagagtgagactcttttaaaaaaaaaatacaaatgcaaatgaataaatgaatgaatgaatgatgcgtatgaatacagatacaaagctacacaaacacatacacacacacacaaataccagtaaaatatatttaatggtatattaagaggagtatacaccatgaccaagtgaccaagggggacttatcctggaaatgcctgtgtggttcaacataagaaaatcaatgtttttaaaaaaaaaaagaaaagaaaatgaatgtaatacacttcattaataaaacaagtaaaaaaaggacacgatcatctcagttgatgcagtaaaggcagttgacaaaatccaacccctttcaggacaaatacattcagaaaacacaaaacagaatagaacttcttcaacatgataaagggcacatatagaaaattcacagctttacatcatattcactgatgaaagaaagctttcctcttaacatcaggaagaagacaaaaatacccacttttgccagtgctatttaacactgcagtagaagttccagccaaacaagaaaaagaaagagaggcatccattgcaaaggaagacataaaactatgcctactcacaggtgacataatcctaaagatagatcataaagaaactacaagaaagatactatagctaatgaatgaattctgcaaagttgcaggatacatcaacacacaaaaatccgttgtgttgctacacacctgcaaagaacaatctgaaaagaaaattaagaaaacaattctacctatagcaccatctaaaagaataaaatactatctagaaataaagttaaccaagaaggtgcaagacttgtatactaaaaactacaaaatactgatgaaaaatattaaagaaggcataaataaaggaaacagtatctcatgttcacagtttgagagatgtcatatttttaaaaggctaataccatccaaaatgatctacagatttaacacaatccctatcaaaattccatcagcatttttaccaaaataaaaagctgatccttaaagtcacgtggaattataagggccctgaatagcgaaaacaatttttaaaaagaagaacaaagtcagaggactcaaaacgtccaatttcacaacttattagaaagctacaataatccaaacagtgggtcatgtcataggtgtagacatacagacaaacggaatacaagtgagagcccaaaaatacactgcctatggtcaactgatttttgacaagggcgtcaattctattcactgggagaaagaaaagccttttctttcagttaatgcaggccaaatattgtcacgctactgacatgagatacaacagtcatactcacagacaaaatagattagaggttaccacaggctggtgggaatgggaatgagtagttactgcttaatggtgatagagtttctgtttgaaatgatgacaaatgaccaaaaaaatgatgctgggttaactggatttccacatgaaaataaagttagaaaataaagttagatccctactttgactatacacaaaaatgaactgaaaataagagctaaaacaataaaatgtttagaagaaatgttcagaagaaaacataaggaaaactttgggtttggtgatggattcttaactatgacataaaatggataagcaacaaaagaaagagtaggtacggccgggtgcggtggctcacgcctgtaatcccagcactttgggaggtcaaggtgggtgatcacctgaggtcaggagttcaagacaagcctggccaacatggtgaaaccccgtctctactaaagccacaaaaattagctgggcactgtggcatgcgcctgtagtcccagctactcgggaagctgaggcaggagaatcacttgaacacaggaggcagaggctgtggtgagccgagatcgtgccactgcactctggcctgggtgacggtgagactctgtctcaaaaacaaatatctgtgtatatatacacattaaaaataattcagtggtaccccaaaaagctaaaagaaatacactttgataaaacaattctactcctaggtttatatccaaaagaaatgaaaacaggaactttgagcagataatgatataccagtgttcactgaagcattattcacaacagccaaaaggtgtacgacccaagtgtacatcaacagatgaatggattaaacagccagaaaagaaagtcttgatacttgttacaatacagatgaaagctgaaagcatcatgctaagtgaaataaggcagacacaaaaggccaaatgttgtcacactactgacatgaaatattcacaacattcaaaactcacagagacaaactagataagaggttaccataggctgttgggaggggggaatgagtagttactgcttaatggcaatacagtttctgtttgaaataatgcaaatgttttagaaattgtggttatggctatacaacattgtgagtgtaatgccactagactgtacacttaaaaactgttaaaatggcaaatttcatgttatatatattttactacacacaaaacaatatattgtcaaaatgctccagcatcatttgctgaatacctgactgaatttcttttgcatttttgtcaacagtttgtcaaatgtcttagcttcagctgccataacaaaataccagacagtatggcttaaacaacagaagtttatttcctcacggttccaaatgctggaagtctgagatcaggatgccagcatggccagggcctggtgagggcctcttcccagcttgcagttggccactgcatgttcacatcgcctttcctctacgcacatggagagtgaggaagctctcacttcctcttcctgtaaggcactaacctcatcgtgagggccccaccctcatgacctaatctaaccctaattacctcccaagggctccacatctccaaacaccaccacactagggttgagggctccaacatatgaattttggggagacatgaacatacagtctataacagcataatcaatgttgaagttttctattcttttccattgttctatgtgtatgttctatcaatgtgtatattcaaccaacatcctgtcctcttgattattatagctattaatatatacatacagtagtcactccttatccaagggcgatacattccaagacgcccagtggaagcctgaagcctcagatagtattgagccctataaatactgttttttcctaaatatacaaacctaagataaagtttaatttataacttagggacagggagagattaacaacatcataaaatagaaaagttataacaatatgctggcatcgctactcttgcactttagggccattattaagtaaaataagggttacttggacacatatagtgacagtaaataatcaagacaattactaagtaattaactcatgggtagcatatacagcctgggtatgctggacacagggttgattcatgtcctggaacaggacagtgcaaaatttcatcatgctactcacaacagtgtgcaatttaaaacttaggcattacttatttctgaagtttcctatttaatatttttgaaccacagttgacctcaggtaacagaaactgcagaaagcaaaaccacagaaaaggggagactaatgtaataagccttaacactggatacaataattcctcctactattctttttctcaaaacttctgagaaaaaatttctcaaaattgtttcatattttatatatatatatatatatatatggttcctttgaccatttatggaaattttggaataagcttatttaaagctgagaaaaaccttactggaatcttgacaggaatgccattaaactgtaggtcaatttggagagaactggcctacttacaaagttgagtttcccaatctatcaagagaccacgtatcttcatttatttcagtgttcttttatttctttcatcagaattttgtaattttcagcacaaaggtcctatacatattttgttcaatttataacaaagtatttaattttctatggaataagtggtattatgtttttaatttagatttgtatatgttcattgttagtggaaagaaattgattatatgtgttcatcttggatcctgaaactttttggaaatcattcattcattctgggaggttttcattttgttttcttttctttttttttgtttttgagacggagtttcactcttgttgcccaggctggcgtgcaatggtgtgagctcggctcatcacaatctccgcctcctgggttcaagcaattctcctgcctcccaagtagctgggattactggcatgcgccaccacacccagctaattttgtatttttagtagagatggggtttctccatattggtcaggctgctcttaaactcctgacctcaggtgatccactcgccacggcctcccaaagtactgggattataggcatgagccaccaggcctggcctgaggtttttattttctaagattccttgtaatattctacatatacagtcatgtcatgtgtaaatgtaaacagttttatttcttctctatgtgtatgccttctctttcattttcttgcctcattgtgcttgaaagaagttacagtactacaatgaataagagtggtgagagcaaacatccttgccttgttcccagttttacagagaaaacatttcatcttaccagcaaatatatctgctatagatattttgtgcatgttcatttatcaaactgaggaagatcctcttaatgtcttgtatagagattttttatcatggatgcatactgcattttgtcaaatgctttctctatattaactgatgttatatcatttttcttctttagcctatggtgggttaattacattgattgatttctgaatgttgaaccaggcttgcttgtataactcaagtaaatcccacttgtttatagtgtatactttttacatgactattttctatttgctagtgttttggtaaagatttttgctactaaatgtatggggagtataggtctgtagttttattatttttgtactgtctgtatggttttgacatcaaaataattttttaaatgtgttaagaaatgttccctcttggccaggcgcagtggctcatgcctgtaatcccagcacttcgggaggctgaggtgggcggaccacaaggtcaggagtttgaaaccagcctggccaataaggtgaaacaccgtctttactaaaaatacaaaaattagccgagcatggtcgcatgcgcctgtagtcacagctactcaggaagctgaagcaggataatcacttgaacctgggaggcagaggttgcagtgagccgagattgcaccactgcactccagcctgggtgacaaaacaagactccatctaaataaataaataaataaataaataaataaataaataaaataaagaaatgttcctgcttctattttttgaggacattgtgtaaaatcatcattaattcttgtgtaaatgtttggtagaattctctagtgagaacaactctctagtacacagaaattggttttttggaggttttttatttaaaatttaaagtatttgattcaaattaagtcaacttttatgaaaacctatgggtcattcaaattatctatatcaccctaattgagttgtaatagtttttggtttctgaaaaactgctacatttcttctatgttgtcatttttctttttttttttggagacagagttttgctctgttgcccaggctagaatgcaatggtgcaatctcagctcactgcaacctcccactccctgggttcaagccattctcctgcctcagcctcctgagtagctgggattacaggcgtgcaccaccacaccaggctaatttttgtatttttagaagagacggagtttcaccatgttggccagggtggttgcaaactcttgacctcaggtgatccgcctgccttggcctcccaaagccctgggataacaggcatgagccaccacacctggcctatgttgtcatatttatgaacataaagttgttgacaagattcccttattatactgttaaatggatggtggagtgatattccctgtttcattccagatattgatgatttgtcatctcattttatatttttaatcaatattgctagatgtttaccaattttattcttttccacagaaccctatgtttcattagttttctctactttttcctattttcaattttactgatttctgcttccagtgttattttcttccttctacttaacagaggttttattttgctctttgctagtttcttaaggtagaaagtcaattatgggtttgcaacctatcatcttctctaatgttagcatttggcactataaatttctctatcagcactgctttagctacctcccacatatattgatatggtatggtctcattttcattaagtctatgcatttctactattaaatttgaggccccttcttcactccagatgttatttagaagtctgatgtttaatttctaaattattatatatttccctattgtcattctattactgatttgtagtttggtttcattatggccagaaaacatacatactcagaatgatttcaattcttttaaatctgccaaggcttatttatggcccaggatatggtctatctttctgaatattccatggacacttgagaaaaaaattgtattttgctgttgttgggcactattctttttccttttttttgagacagaatctcactctgtaacccaagttacagtgtagtagcacaatcttggctcactggaacctttgcctcccagttcaagagattctcctgcctcagtttcctaagtaggtgggactacaggcatgcgccaccatgcctggctaatttttgtatttttagtagagacaggatttcaccatattatccaggctactcttgaactcctgacctcaagcaatctgcccgcctcggcttctcaaagtgctggaattacaggcgtgagacaccgcacctggccttgttgagcactattctataatgatgcttcagtcctgttggctgatgttgctgtcctgttcttctatatctgctagtaatcatatggctagtaattctatcaattgctaagagggaagtgatgaattttccaactacaattaaaatgtgcttttctcttttcaactcaatcagttttgttttgtgtactttgaggtttgctagagacacatttaggatcattgcatttttgttggattgatccttttatcattatataatgttctttttgtctaatagttttctttgctctttgctctagagtctactgtattttgtttttgattaatgtttgtacagtttatctttttatatactttatcaacctatgttgttcactatgagtttcctaagaaaacatttttaggatgggtggagcaagatggtggaatagagaacgccaccgatcatacacactcccccgcaggaagactaacattggcaactatctacacaaaataagcagtttcacaggaaccaaaagtcaggtgagcacttacagagcatggttttcacttcatatggctgaaagagaacagtttggaagttcctgaaaaaactaaaagtagagctatcatataatccagcaatcccactcctagatatatacccaaaagaaaagaaatcagaacatcaatgagatatctctgctcccatgtttactgcagcactgttcacaagagctaagatttggaatcaactgaagtgtccattcacagataaatagataaagaaaatgtggtacatatacacaatggagtaccattcacccataaaaaagaatgagagatcctgtcatatgcaacaacctagacagaaatggaggcacagaatgttaaaattttgcatgttctcacttatttgtgaaaggtaaaaattaaaacaactgaactcatggagatgaggtagaaagtaaaaggacagtaactagaggctgggaaaggtggtggggtggggttgggggaaggtgaggatggttaaagggtacaaaaaaatagttagaaagaatgaataagacctaatatttgctagcccaacagggtgactacagtcaaaaataatttaattgtacattttaaagtgactaaaagagtgtaactggattgtttataacacaaaagataaatacttgagggaatagatacccaatttaccctaatgtgattattacacgttgtgtgcctgtatcaaaacatctcctgtaccccaaaaataaatacacctactatgtactcacaaaaattaaaaattttagatcatgttttatgttttttccactctgccaatttatattttaattagtgtactttgattatttacatttaaggtaaatattgctctgttaggctgctatttgttttcttttctgttttctattcatctgttccttttttcttattttctgattagttacctaaatattattttagattccatctgggtttatttatagtgtttctaagtgtaccacattttatagttttctcagtagttgttctaggtattaaaatgtacatatgtaagttatcacagtctatcaagcattttaccacttcaagtgaaatgtaccaagtttcattccacttaggcccctttaccctccccacttttaaaatataattgtcttaagtgtttcccctacatacagagcattttgctccaaccatcaaaaatgattctagaaactcacgagaaaaatatatttatccccatttttgccaacctccaatcttctttctttcctgcatcccaagccttcttgttatttcctttctatttagagaacttttagtcaatttttaaaggtaggtttgctagcaacattttctcttagcttccctatctaataatgcctttagttcccctttattcatgaatatagtttcaaaagatacagaatttttatttaatagtgctttcccctcagtacttgagaaaatatactacttcctgcctgccaccacagtttcagaagagaaacccacagtcattccctgcagggaatgtgttgtttctctctggctactttgaaattttttttgtctttagttttcaaaaatttaattatagtgtgagtttgccatggacttaacttattggatgttacttcagactcgggaatgtgcagttttatatcttttgctaaatttgagaaggaccagccattacttcttcatatactttaaacacctccttcacttccttctgatgttacaaatgttagttcttttgttattgccccactttccaaatactgaaagaatcaaacctcatcccattccctcctgccttccggctttgtctaagctaccacaatcactcataaggaaaactaccacaggactttaatgagctctctatgccctatgccctgcccaatattttctctacagaggtgagaaagatcttacagagatataaatcagatgttgctcatctgctgaaaatctaccactaaacagattttaaccaaataaggcttatgataggctcacctttggactctagctgcctccctcacctcacctcctgcccttcctccaatcaagccctcccttcagccactgtgactttttggtcattcctgaaaaccaccaagcacattcctgtccaaggctagcagctgctattacccctgctgaaaagaggcagaatcctcatggctcacacagtcatttcattcaaatttctactctaatgttgacctcagtaaggtttcccctgactgttccttaaagtaatctaaacttgctttaatttctttcatagtctttaaaaccacagaacacttaatatacataaacataagtatacataatatacttagagacataattttgttttttttttatatttatttacttatttttgagacagagtctcgctctgtcgcccaggctagagtgcagtggtgcaatctcagctcactgcaacctctgccttctgggttcaagtgattctcctgcctcagcctcccaagtagctgggattacaggcacctgccaccacgcccagctaattttgtatttttagtacagatggagtttcaccatgttggctaggctgttctcaaactcctgacctcaagtgatctgctcacctcgacctgtgctgggattacaggtgtgagctaccatgcctggcctaatttttttcattatcatatcctcagcacacaccaagtgctcaaaaattatttgctgagtttaaaaatgagtgaataaaaaattctgacagaagaataaacacaaaacaatggaggttaaggtgggacactgaaagtgctttgagaaaaataaccaagaaaaacaacagtaaagttgaggtgggcaaagactgaactattggcaggtgtaagaatggtaaaccttcaaaaaatgattctaaaaggaaaaattttttgtgagtagtatctggaggtttgatttagcaatcagtattctccatcacttccagaggttaggacccctatggagatgttcttgaaaaatgttccaaagttgccaaaccctgaattaactactgggaaacaacaaatcccctgatgtgaatctgtgcagtacatattaacccacctggaaagctctggcttgggaattcttcctccagtctccatggttcttctccttgttccagcctgaagatcacctctggtttgtgagcacaataccctgttaacaggaaataatttaggatttggaccaagcagtctagacttcaggcctttgaagcaggaagaagcttctggggctgcttcaagttgccagtggaacattttcactggagaggtgaacacaagtatcttctggtgctcaatcaacactgactcctgaagcctaacctaagcctaaataatgtcattaaactagacagactgcctatatgttttataatcaaaataaacgaatgctatttagaatgatacagtgaacagaccttacccactgagacaaggttgctgtagttctccagcatcacatctctatacagagccctctgactagggtccaggtgctgccactcctcctgggtgaagcccacagtcacatctttaaatgatactgacccctggaacttctgatctacctgaaatgttcagaattaggtggcatgaaaaaagaagtatgggctaatccttaccatgattattattcacagaatatttgttttgctttatacttttagggaaaaaagaaatcataacagaaatattctgccattaatgcattaagatattaattcatgcaaaaaaattatcaagttcccacaatgtacctggaactatcatcactcctggcaacactaagattaataaaaatcttcctgtgttcaaagaacacacagagtggtaagaaaatatacatggtaacatgttgcaagtactaaggtgaaagtacaaacccaacagactaacgttaggagcaaagttagctctgctttgagtttcactgaggaagtatagctgttggttgaattatgaagaacactctattacgtccttcataagcacggggccatgatacaagcaaaggtgagggcctccaacacactgcagacatcaacaaaagggcagacagcacaggaaatggcctgctgctgtcttgagaagaaaagccaaggaaatgggttacagagtaattttacaccaatggtctctaaagtatttgatcatttaccattttcaagaatattactgagaactacagatttatatttacaaatcacagaaataaattgtcagtacatttattatgaattctaatttaattctcatttagatttaaaaatgtagaaagcctgacattttcttcatcgcagtacatattctgggttctaatcctttaattcaaagacaataatagggatgtgtagaaaatggaaagatcttggaactattatacttgaaacctctgtggagtacataggagaagacatccagttggattgttctggatatcctctagggcacatcttttagggatcactgctgtgaaaaagggagagccaaagatgagatgtgagcatatactgcaattatgtgaccaggttttgtttacagaaccaattctattgagaacagcaaaggacaaaacaacatttacataaactactgtagaagaaaccaggatgcaaatagggcatgaataataggagacagagcatcaaaatgtggtcactaattcattaagaaaaaaaatgtttcctctggctatccccatgaacagctgctcagatactagggccacaatgtaaaccaggaaagttagggcaaaataggttggacacggtattctagcaagaaatgtcctaaatatattaaatttgaagcacaggctgggtgcagtgcctcacgcctgtaatctcagcactttgggaggccgaggcgggtggatcacctgaggacaggagttcgagaccagcctgaccaaaatggtgaaacctcatctctactaaaaatacaaaaaattagccaggcgtggtggcaggcacctgtaatcccagctactcaggaggctgagacaggagaatccctttaacctgggaggcagacattgcagtcagccgaggtcggcaccactgcactccagcctgggtaacaagagcaaaactccatctcaaaaaaaaaaaaaatgaagcataatatgaagatcaagaatgaaacaaggactacagagacatttataatacagtggtgctcaaagccatcaagagaaaatcagaaggatgtcagaaaactggggaaagaaaataatcaagaatggaatcagaggctaagcacagtggctcacatctgtaatcctagtactttgggaggtaaaggcaggcagctcacttgaggtcaggagttcaagactagcctggccaacatggagaagccctgtctctactaaaaatacaaaaaaattagccaggcgtgggggcaggtgcctgtaatcccagttgctggagaggctgagacaggagaatcactcgaacccaggaggtggaggttgcagtgagctaagatcgcaccactgcactgcagcctgggcaactctgtctcaaaaaaaaaggtaagaaattcctcccaaatttatatataggttcaattcaaccccaaagaaagtctcagcaagttattttaagaatactaacaatatttgtatggaaatgcaaggaactaggaagagccaggatttgctgaagaaaaaatgtgttaaacccactactagacactaagatgtttcaccaagtgaggtactggcacaaccaaccaacagaacacagtccaaaaaaacacacagacatatatgtacacataattgatgaaaatatcacaatgtaaaactggggaaaggatggtgttttcaaaaataattctacactaactgtatgaaaaacaggaatctgacatccacctcatacaaaagtagacacccattccaatgaaagagaggtaaatgtgaatgccaaaacaataaatattttaaaagataacaaaagagattatcttcatgacctcaaagtaggtaaagtcatctaaaatagcacacaccatcaacaaataaacttaataaactaatctagggattggtaaactttttctgtaaaaaatcagacattaaatatttagccaggcatggtggctcacacctgtaatcccagcattttgggaagccaaggcaggcgaatcacttgaggccaggagtttgagaccagcctggccaagtgaaaccccatctctattaaaatacaaaattagccaggtgtgatggcatgtgcctgtaatttcagctactggggaggcttagccaggagaatccctggagccctgaaggcagaggctgcagtgagccaagatcgcaccactgcactctagcctgagtgacagagtgagacattctccaaaaaaaaaaaaaaaaatcagacatcattatatttggggctttgcaggccaaaaggttcctgtcacaattagtcaactctgccactgaagccacagattaaatgtaaatgagtgaatgagcagggaggtgtcaggattgtgagggggacaagacggcagctgcaggagggctggcaatgttttttttgacgtatgtattcattatttgcgccatggatttgtaataattcattaagttctatatttaaaatgtaggggtttttccatctatctgctacacatgtagaaataagattcattaaaaattaaaatatgtaatcccagcactttgggaggccgaggcaggcagatcatgaagtcaggagactgagaccagcctggccaacatggtgaaaccctgtctctactaaaaatacaaaaattagctgggcatggtggcgcatgcctataattccagctacttgggaggctgaggcaggagaatcacttgaaccagggaatcggaggttgcagtgagccgagattgcatcactgtgctacagcctggcgacagagcaagactctgtatccaaaaaaaaaaaaaaaaattaaaatacactttaatttattggccgggcacagtggctcacgcctgtaatcccagcactttgggaggccgaggagggcagatcacgacgtcaagatatcgagatcatcctggccaacatggtgaaaccccgtctctactaaatctacaaaaattagccaggtatggtggtgcacgcctgtagtcccagctactcgggaggctgaggcaagagaattgcttgaacccaggaggcagaagtttcagtgagccaagatcgtgccactgtactccagccaggcaacagagcgagactctgtctcaaaaaaataaaaaaataaaaaatttaaaattaaaatacattttaacttactgatcaaacagtacatccaaaagaaaattggaacctgtataaaataaaaattaaaaaagcagtttgactcaataggctgcactcatttcagggctaacactggaaggttattcactatgggtccctatgttataaccaaaaaaggtatctgccaggaagtctttgtgtcttcagaggagtcagtttgtctgtatccatatccagtgtcttcctttctgccatggttgttggaaacataagaaacacatgaagctcaacttattgactctaacttggccctgctattgatctgttactttatattttctgggaagttcaatttttatctattactaatttctcatcttaacatattgactcttggccaggcacggtggctcacacttgtaatcccaacactttgggaggccgaggcgggcggattgcctgagctcaggagtttgcgaccagccagggcaacacggtgaacacatctctattaaaatgcaaaaaattagccaggcgtggcggcctgcgcctgtagtcccagccaatcgggaggctgaggcaggtgaattgcttgaacccaggaggcagaggttgcaaggttgcagtgaacagagatggagacactgcgctccagcctgggcgacagagcgagactccatgtcacaaacaaaacaaaacaaaaaaaccatactgactcttacaaatctcacaaagtccaccgcaaaataaagtagggaattaataaacaacttaccttgttcattttgttctgttcttggaaagacggagacaactctgaagatacagctgagttggaaaaagaggaatggggtcatgaaagatttggcctgcctggcaactcccggattcttctgccctaagaagccatacacacccactaggtaaaatgctccgtctgggagaatatcaatgtcctctgacacttcggaatagggggtagaaatggtgaaagaacaccctaatacaactccaacataaccatgtagctcttgggcacaagatttttcatcaggtgaaagtaaatatttgcttcctaaggatttcaatctccctcagtcttcacaaaaaatgtataatgacaatattggccaaacaagttaacaatacatttaatgaaaaaacattaacactaaaaccattgtaaagaataggactaggctatcgattttcccagtaatgttacttaacctctgatgagttagtccacagaaaaccataagcgtcagtgcttcaaagaaaaaatccgttttaatttcttcatctaactttgttgctatttctcaaaaggatgttttaaacttgctttgatgtgtgtagaaaagtagtactggcttaggggtcaggagaagtgacttttagttctccctactaacaaactttgatcctgaacaagtcagtaaccttgacaaacaaaaaacaaaaaaattattttttcttctaacaaatgaggcaaaattaggtaattctggttttttgtttgtttgtttgtttttgagacggagtttcgttcttgttgcccagtctggagtgcaatggtgcaatctcagctacctgcaacctccgcctcccgggttcaagcatttctctgcctcagtagctgggattacagtcataggccaccacgcatggctacttttagtatttttagtagagacggggatttgccatgttggtcaggctggtctcgaattcctgacctcaggtgatccaccctcctcggcctcccaaagtgcaggattacaggagagagccaccgcgctaggccaaaattatgtaattcttgaagatccttcctgagtgcaagatcaagttaggacagaggaacagcaaataacaagatggggtgatggacatgactggagggcagttcgaaacctaaagaggatgaacgcagaacgggcaacagagtccgtatgtcgggcgggcgactgcacccgccctttcctacccaggtagggccgcgccctagcacatgggcgtaaacacgctcaaccagagaactgcccctcccgcaaggctcagcgctcggaccgcgcaagcgcacatgccctcctccgcggcccctacaaacagggcaacgcacagggcgtagcccgctccctacagaggctgcgccttagaggaactggcgtagcgtcctggtagacatgctgcagccccgccgtccccggcttctccgtgaggtccccgggactcctcgccaccacctggcactggcccccggctgcctgctcctggagtcgcgcggggccccctctccgtccctgcccaacccgcggaggcttacctcactctctcttcgggttgcattcgccataagagagccggtagacccctgaaatcccgggaccgcctcccacgcaaaacgtgagacaaacaaaaggaaaggcggaaacgcagaaacgcagaggtagccagtggatgaggcatgcgcagagcccacgctcaaagcctggcgctgttggcgcccaacctggaaactacctttcccgtgaggacgcgagagcagcccttcgggattggcagagaggtgccccgctaggcagtggacagatgcggtctgagttggtgtgggaactgcccgcagccctggctctcccggggcgacccaaagggatgcactgcaggggaggtctgtgtgcagcaagtgtgcaggttagacacagacgcctcaaggaaaggacagctgtgtgtcagtttcactttaaatgttaggaagtagatcttattgatacagtttaaaagactttgacactatcagcgattctttgagagcagggatgggggggatgggggaggtgccacaggaaagctacttcatcaaaatcgttaacgcaataaacggaaattgaaaagtcagaaaatagacataatccgaaagaagaaaataaatgtcacatgatttcccctgtgacattaaaattgcttgactaaatggaaatacatttagtctatctgtacctttcttaggaagacaaaattcctaaaagaatatcaacaaatttttttatgtattttttctctttgatctttagtgtattgtgtactttacaaaagcattgtcaactttatccagagtaagtaaaaaactaaatgaacagccattatacgttttaaaaagcttgaaaaaatgcctgagaaatatctatatctatctatatatataatattgctctattcaaagtagtttggcacctgctccatggaaataagacaccatgattgagagtattctttaatgtgtagtaaatacagcatttcaaaacagtgagggaaagaatggagtattccaaagagcatgtcattcctaacaatttggaatatagagatatatatagatcacacgtgataaaattcacatgtatacagtattgaaacatttaaacgagtataaatttttgaaaattgacatgtgggccaggcacagtggcccacacctgtaatcccagcagtttgggaggtggaggcaggaggaccacttgatccttagagtccaagaccagcctgggcgttatagtgggacccctgtctctacaaaaaattaaaaataacaattagctgggcatgtaggcaggcgcctgtgatcccagctactcaggaggctgaggttggacgatcacttgagccccaggttgcagtaagccatcatggcaccactgcactccagcctgggtgacaaagtgagactttgtctcaaaaaaaaccaaaaagggatgtgataccaaagacagaaactataaatttaatatcagttacattttataatagagaaaaataagcagctccattccagcaaaactttttaagtccattatgagaattgaaagaaatgcaaatatggccgggcatggcagctcacgcctgtagtcccagcattttgggaggctgaggcgggcagatcatgaggtcaagacattgagaacatcctgcccaaaatggtgaaaccccttctgtactaaaaatacaaaaattagctggacgtggtggtgcgcacctgtagtcccagctagtcaggaggctgaggcaggagaatcgcttgaacccgggaggtggaggttgcagtgagccaagatcgcactactacactccagcctggtgacagagtgagactgcatctcaaaaaagaaaaaaagaaaaaaggaaatgcaaatatttgagtaaaaatatgtgaaacatattgaaatttacatttttaaatttatgctttatatactgaaaagttcactttatttgttgcataattttatgagttttgacaaacgcacagatttgtgtaaccaccaccacaagcaagatacaaaattatttcacctgtcaataaaattcctccatgctaccttttgaaagtcagattctctaaccactcttagcctcttgcagccactatctagtctttgggcctgtatgtttgccttttttagaatattatataaatggaatcatacaatatgcagtctttgaatctggtatcttttacttaacacaatgcaattgagatccttccgtgttgttttgtgtaccaatacttctgtttttcttgctgttagaaacaagtgcctggtgccgcagagaaaaccagcacaaaggcagaaaattcctcagcaagagaaatttacttctgcagaagggtgcaggttatgccagtcatgatcacaagagaacaccgagaagggcagggcaggggtttttatccctgatgcagttcctagcacttctgtgtcccttccccattggctgggattagacctcacaatcaaagctaactcgattggctaaggtttaaaattgacagggtctattaggcgggaaggaagggggactgtccattactaagcgggaaggcatatccggacttgtctgggcatggcaaaggcgggaaggttgtttacagaacaggtagcttggagacaaggaagtacaaggaagttggtcttgagcaacaaacaacagggaactaaagctttctgaagagtaatttgtcaactctgacattgctgactcctatttcttggtatggatttaccagcttccttgtccattccccagtccagggatatgcaagttgtttccaattgggagaaattgtaaataaataaaatatttttaagtttaagatttgaaaagattgtaaaaaacactaatatacacctatggtatgggcttggggaaatgtttattcccagtgtattaatcaggattctccagagaaacagaaccaataggagggagtaagggagaaagagacattgatgatgagaaattggttcacatgtctatggaggctaagaagtccaacaatctgtcatttgcaagctggaaatccaagaatgctggtggtgtaattctggtatgagtccaaaggcttgagaaccacggaagccaatggtgtaaatcccagtgcaaggacaggaaaggataagatgaaatgtcccaactcaacaatgaggcagaaaatatgggtgaattcctcctctctgccttgtgttctatccaggcccttaggggattgaatgatgtccatacacatacggagggcaatctgctttactgagtctactgattcaaatgctaatctcatctgtacacaccctcacagatgcacccataagtaatgtttaatccagacaccctgtgaccaagtcaagtttacacataaaattaaccattaaccatcacagctattctatttttttttttttttttttttttttttgagacagagacagagttttgctcttgttgcccaggctgcagtgcaatggcatgatcttggctcactgaaacctctgcctcccgggttcaagtgagtctctcaagtagctgggattacaggcatgtgctaccgtgcctggctaattttttgtatttttcctaaagacggggtttctccatgttgttcaggctggtctcgaactcccgacctcaggtgatccaccagtctcggcctcccaaagtgctgagattacaggcctgagccaccacacctggccacagctattcatttttacggtgaatttgattaactctggaggctcattttttcctctcatttcttcttcggtttttgtacctttttcccttttacatttcgttgacacctaataattgtgcatatttaggggatatagactgatattttgacatgtgtataaaatgtataatgatcaaatcaggttaattagcatatccctcacctcagacatttgtgtgtgtgttgtaagcattcaaaatcctctcttctagctttttgaaaatacacaataaattacagtcaattatatttatcctacagggctgtggaacaccagagctcatttcttctatctagctgtaattttgtattcatataccaacctttccccatcctgccctccccactaccccctcaccctctaatgcccataattctactcactacttctatgagccccaatttttttagctcccaaatataagtgaaaatgtgcagtaattatctttctgtgtctgacttatttcacttaatgacatccaggcctatccatgttgtggcaaatgacaggatttcatttttatagcagagtaatattccactgtgtttatataccagattttctttttccattgatgtgttggtggacgtttaggttgatattatattttggctattgtgaatagtgttgctataaacacaggagtgcaggtatccctttgatatatggatttcccttcctttggatatgtgcccagcagtgtgattgttggattgtatggtagttccgttttattttttaagaaacctccacactgttttatatagtggttgtaccaatttacattcccaccaacagtgtctaagagttcccttttctatgcatccttaccagcacttatttatttttcttataatagacattctaactagggtgagatgatgcctcattgtgattttgattggcatttccctgatgattagtgatgctggacatttttcatacatttgttagccatttgtatgtcttcttttaagaaataattattcagatcctttgcctgcattttaatcagattacttttgtttttgtttttgccatcgagttgtttgagttatttgtatattcaggatatttgtcccttttggataaatagtttgcaagtattccctaccattctacaagttgtctcttcacttccataattgtttcctttgctgtgcagctttttagtttaatacagtcccacttctttttgttgttgttgtctgtgcttttgtttgtttgtttattttgagacagagtctcaccctgttgcacaggctggagtgcagtggtgtgattatagctcactgtagcctctacctcctgggctcaagtgatcctcctgcctcagcctcccgagcagctgggattacaggtgcccaccagcatgcctggctaaattctgtatttgtagtagagatggggattcaccatgttgcccaggctggtctcgaactcctgtgctcaagaatctgcccacctcaccctcccaaagtgctaggattacaggtgtacaccactatgcctggcctgtctgtgctttttttttttttttttttttttttttgagatggagtctcactgtgttgccaggctggagtgcattggcttcaacctggctcactgcaatctctgcctcctgggttcaagcaattctcctgcctcagcctcccaagtagctgggattacaagtgtgcaccaccacacccagctaatttgtgtgtgtgtgtgtatttttagtagagatgggttttcaccatgttggcctcaatctcctgaccttgtgatccacccaccttggcctcccaaagtactaggagtgcatcaccatgcctggccctgtctgtgctttctaagtcttagtcataaaacttttgcctaggccaatgccctgaagagtttgctctaggttttcttctagtatgtttacagttttggtcttatgtttaagtctttaatccattttgagttgatttttgtatacggtgacaggtagggatcaagttttgtccttctgcatatggatatccagttttcccagcacaatttattgaacaggtggccctttacacaatgtacgttcttggcattttaattaaacgttaaaggacttataatattataattccacttatatgactttgtaataataaattattgttgatatatgtgcaagtatatttaaatcaatcagagttcaaatggtaacagagagatcactcaagtattacaactgagagaatttgatgaagattatttaaagcaggtgttttaatggtaaaaatgaacactgagctaacacaggatgacaacatcaggtagcagctacctgtctagggctgggaaacaatggaaaagattaaggttctcggaacctagaaactcacaagagtggccccagagagctagaattagacaagacagcggaggcaggggcagtgccaggatcatgctggtacctcaggtattcagagaagagctttgcagaactggaattcagatgctgtccagttgctaactgaactttcaggaaggcatgttgaagcacattgtgttcacctctgaaagtcgttactgtccagctggtgctagtagccagagtgggatcaatgtggagagttctgggagagctaaaagaagctggagggtgatcaacatgttctggaattagatagtggtgatggttgtgtaactttgtgactataattattgaattacacacttttaaaggagtaaattttgtatgtaaattgtatgccaatgttacaaatacttttttttttttttagacggagtctagctctgtcaccaggctggagcacagtggcatgatctcgactcactgcaacctccactgaagaaggaattcatgaattttacaagtataatcaaagaccaccaagaaatttttactttttccttcaaaagctaagtgtagtgtagcaccccctgcccatagtctaagttacagaagaatactaactgcctgtttttctttctgtgttgtgagccttatctgttctcaccagtttcacattccttgaggctcagtgagttcctgcgcacctccctagcacagctgcaaagttacaaggttgatatgcatatgttacagaaacatagtttcccaaggatgtggaacatgtagtatagataaatgtaaaagactgatcaactgcctttgttctcgcttgtgtaagtagacttcatgaatcacatagctcccggccactgactgcttaaaaggtggctgcattctttctccagggctcagactttcctggacgctagtcctactgagccaggtgatccccttaataaaggctttcctgaactctcttcagtctctcccgtctctgattgtcccataacatttctgggggcctgtctgggattggagatggcaggtttctgtctcctttgcctgtgggctaaagccacaggacgcgggagatttgggaactttggtgccactggggaagacttagcccagaaggagaacggctcccatgtattggagcctcgccctgacagcgcaaacggaaccgactcaggagttgcaggacagtcacaggagcagtgcgctggcagactactgaaccgccataaggttgggccctggaaaagcccatcccataaggacagaaggggagcttgattaccttccccggaacgatcacttatccaacccagagtggctgggggcagcaggagtggcctgccaatttggatgaatctcgtgtccccacacaagcaaaagtggttcactggatctggagacagaaactgggagtgttttggtgtgtgtgaacctactcgggacataaagaaggcttctttcatctgatcagtcctggggtaggagtggtttgtgtatgtgtgtgaatgtggaagcctaactaagctcactcgggacatgagagaggcttgtttcatccgatgaggagtcctggggcaggggaggtgtgtgaaagtgtgtgaaagaggtggtctcggagaagccaacacggggagtgatgtggggagttgcagatcttagtgcagactgtgtccctcaaggtgagtgtgggacaagccagacctaggtcactgcataagaccgacaagattcacttcatggtagcttcacagcagtagttggctgtgacctggccaagcagcatccaaacctcctgtaataggaccctgtctggtgcatccaagagtgaaagtgagagtgaaagtgtgccacgagggaggcaataggaggaaaagtattgaagccaactccattagaacatatgttgaagaactttaagaaaggctctgatggtgattatggaatgaagttaacaccgcagaggctaagaacactttgtgaaattgactgcctctccttcaacatagggagggcggccaagggaaccatagatagggaaataattggccgagtatttagggtggtcactggggttggagaacagcctggacaacctgatcagttcccatacatagactcctagctgagcgtgattcaaacccatctgaaatggctacaggcctgttttgaaaattattgtaagactctggtggctcgtacaaaacaaggaaccatagaaaagacccacaaagtgtaggcccaggagaaagaacagcaaggaaaacaggaaaaacctgtcctacaggccccactagaagagctagagactccatccccttatgttccaatttatccgcctctggcaaggcttaggcaggaagtcactccagcagctgcctgtggagggtcagactcagaggagagtacccttcaaacttcaccacatagggaagagccagggtcactgcccgataattcaaaggaggaactccagtatgacggccatctccggtcaggacacgcccgagctttgcagatgccattcagagaacctaggggacagatctatttagatgcacaaaatgaggttcaaggaggagaacggctttatgtttatcagcccttctctactacagatattttcaactggaaacagcatactccctcctatacagaaaaaccccaggctcttatcgacctgatgcagtccatcttcttaactcacaacccaacctgggctgactgcaagcagttccttctgtcactgttcaatacagaaaaacactgcagagtaatacaagtggcttatcagtgactagaaagcaatgctccagtaggcacaggagatgtcagaaagtatgctcagcaggctttgccaatagaaactgacccaggctgggacccaaatcaggcctaagggctgctgaacttgctgagataccaaggggctctgatacaaggaataaaagctggagggaaaaaggcaacaaacactggaaaggtttcagaggtccatcagaaaccagatgaaagtaccagtgagttctatgagaagctttgtgaggcttaccggctctacacaccttttgacccagaagtggcagggaatcagtgcatggttaatgcggcatttgtgagtcaggcacaaaatgacattaagtgaaagttgcagaagctggaggggtttgaagttatgaacatttcccagcttatccaagtggcaactaaagtgtttgtaaatcaagatgaagaagcaaagtgggaggccaagcatagagtgaaggaaaaggcagagttcttggctgcagccctgattgaaagagaggctggatttgcaagaggacatggacatggtcgtggatgcagtcatggtaaaggacaagctagggctaggccaggtcaggagaccaggacaggtcaggaaggttggcctagactagagagaaatcaatgtgcgagatgcaagcaaagagggcattggaaagatgaatgtccagagaaagaaaagaataaaggctacaagcagggacagaatggctggacaaggcctccttctgctgctgggcagggcatagtaggatgcgatgtggatctaattgggctggcaggagtcagtgactaccttgaagactgagacagactgggctacatctcattaggccctgaggagcccatggtctcaatggtagtagggggccgaaaaatagaccttatggtagacacaggtgctgaacactcagctgtgactcaaacaattagggtgttatcaaaactctatgctaatattattggggccacaggtatcacagaaaaaacaccttttttcacatcaaagagaggtataattggaaaccaagaagtccaacacaagttcttatacttgccaaactgcccagtgccgttgttgggagagacttgttgcagaagctgcaggctcaaatctccttcacactgaatgcagatataccttgagcctagggcaaaagaaggctatggtactaactcttacagtacccaaggcagaggagtggagactttatgaaagtagttgtcaggagtgtggaaaggagtacagctgagaaagaaaaactgttcacagacttactccctaagttaccaggagtctgggtggaggacaatcccccagggttagcagtaaatcaagcacctgtcatagtagagctactacgaggaatctacccagtgtggatccatcagtatcccattcccatagaggctcaccaagggattgcaaaacacttaaaatgactccctgaatttggaataatagagagatgtgtctcctcacggaatactcccctactgctggtgttaaaaccttctggcaactaccagcctgtacaagatttaaggacagtcaacaaggtagccagtacactgcatgctattgtgcctaacctgtacactatgcttggacaaatacctgctagtgctgcttggttcatatgcttggacattaaagatgtgttcttctgcatctgattagcccctataagccaagacatttttggttcatatgcttggacattaaagatgtgttcttctgcatctgattagcccctataagccaagacatttttgcctttgagtggggcccatctcagtatacctggactagacttccccaaagatttaaaaactcctcaactatctttggagaagcactagcctcagacttaaaggctttcacaccaccaagtgatcgcttgtcttactgcaatatatagatgatctgctgttagccaaacccacaagaaaataatgtatccaaggaacagagagtctccttcaagtgctgtgggaagctggctataaagtgtctaagaaaaaggcacagatctgtggctgaggagttcagtatcttggattttacttctcccaaggacggtgtgagcttggacaggagcgaaaagagattgtctgtagcattcctcagccagacagaaggcagcaagtgcaggaattcctaggggcagctggtttttgccaattatggattcctgactactggctcctagcaaagcctttatatgaggcaaccaaaggaggggaaaaggagcccctcctttggggaaaagaacaggacatggctttcaaggaaatcaagaaagcttcaatccaggccccagcactaggactgccagacatgacaaagcccttttacctgtatgttcatgaaagaaaacaaacggctacaggagtctaagtgccaatgctagcatcgtagtatcagcctatagcatatttgtccaagcaactagacttggtggctatgggattgccaccctgtttcaaggtgctggccgccactgccttgttagccaaagatgctaacaagctcacatttgggcagcagctgataattcaggtgccccacacaattgtcaccttgatggaacagagaggacattgttggctctctaaccgtaggatgctaagataccaaggactcctatgtgagaatccatacatcaccttagaggctgtgaataccctaaatctggccacactgttaccaatagaatgtgcagaacatggaaagtccctgttatgtgccccagggtaccactgctgtgtagaaacagtggatgaagtattttcaagctgggaagacttaaaggatcaacccttaagaaacccagatgttgaatattttactgatggaagcagcttcatatctgagggtatcaaaaaggccagatatgccgtagtcacattaagctcggtggctgaagcctgccccctaccagtaggaacctcagcgcagaaggtagaactaatagctctcacaagagcactatttctagtgaagggaaagtcagtgaatatctatgctgactcaaaatatgcttttgccaccttgcatgctcatggagccatttacgatgaaagaggactgttaactactgaaggaaaagaaataaagaacaaaaaggaaatagagcagctcctagaggctgtgtgggctccaaaggaagtagcagtcatccattgtaaaggacagcaaacaggaagaagtgataaggctacaggaaacagcaaagcagacaaggaagcaagaaagactgcaatgacagaaaaaacaaagaaagaagagacttatgccatgcccttattagagcctccccttgcagacactcctaattactcgtccaatgagaaggcatcgtttgtgcaggaaaacgggagttatcagaaagaaggctggtggaagttttcagatgggagacttaccattccagaagccattgccccccaatttataaagcagtttcaccaaggaacacacatggggaagacagatttaaagattctcatagggcggtatttcattgtgccatgcctaactgccatgactcgagccatctacgagcagtgtgttacttgtgcccagaataacccaaggcaagggcctacttggcctcaaggaattcaggaaacaggagcagtgccatgtgaaaacctacttgtagactttaccgaactgcctcaggctggaggctatcggtacatgttagtgtttgtctgcaccttttcaaggtgagttgaggcattccccatcaggacagaaaaggcacgagaagtaaccaggatattattaaaagacattattcccagatttggactgcctctaaccttaggctcagaaaatggaccagattttgtggcagaagtagtacagcaactaactcagatgttaaaaattaaatggaaactgcatacagcctaacatccacaaagatctagaaaggttgtaaggatgaactggacactgaaacaactgttgaagaagttttgccaagagactcatttaaggtgggaccaggtattgcccatggtccttctctgagtcaggtgtacccctacaaaattaactgggtgttcacctatgagatagtgcatggcccaccacccccactcatatctcaagtaaaaggagatttaaaggaaattggagaactgaccctaggaagacaaatgcaggtattaggtgaggtaatgcaagaagtacaagggtgagtaagagaaagaatacctgttagccttacagatgcaatacattcctttcaacctggggacttcgtatgggttaaatgctggaatcctaccacccttgggcccttatgagatggcccccatattgtgaccatgtctacccctactgctgttaaagttgcaggtattacaccttagatccatcacagctgactgaaacctgcagcctcagttcaagacatgtggacgagtcagcaagatccagatcatccaactcaactgatcttgcagaggaaccaaggcgcagtaggaaaagacgaccaccctgctccgaccacaccagaagctggtctgtcaatgcacagctgaagcttaaggaaacgtcaagccctgctctagtcacacagctggaaggtgactagtctacgcatggctgaagcttaaggaaaagtcaagtcctgctctagtcacacaactgtaagctgactagcctatgcacggccaaagcctgaggaagccagcactagataagtaaatgtagattgaatttgcaagtgtagttatactattgcttatactgattgtcttgctgtcatgctatctttgcaattgctatcaaacttgttgcccgggaggatgcctgtgcatagtataaacttaatcacactaatgacaataatgttaacaggcatgggaggaaatcaagataactgtcattgtatgatagaaagttggtctggtaaaggtataactaaaaccctgttatatcaaacttattatgagtgtacaggaactcccctggggacatgtgtttataatcaaaccagctactccatctataacccaggaaataggcaacctcaagtatgttacaattcaggcctcctaccctgtggcttctggtttgaaattaaaatagggaaacctttattaccctcatatgccaatcctaaagatgttagaactgggaaactcataagcaaaacacaggtattcccttatttacataaaggatctgtttctatatattttgatgcctgtcaggctgcacacctcagcaacctaaacaatctaggagtagtctgcaagaacttaggacaagaaagactcagcagcaaggctgctaagatcataacaggagaaccagaagaagaatgtcctgattgtaacattcaaaggaccacacatgagttcagccaatgcctttatgcaggaagagtagctctgctaaccagccaagaagcaaagattggttgtgcgactaaaatatgcaacccccttaatctgaccatattaaagccaaacatgcctttttggactaaagaacaccaaggagagctaagctgtgctcgagaaggagcaaatctgggtgttctgttaatcattattaaaaagacacagtgagctaaagctcaagtcagtccaatgtcacagttcagatttctcaaatccttcaataaacattttaaccccaaggagccaaaagttcagattccaccaatgttagccaagaacctattcactcagctagctgaaagtattgctactaatcttggagtcatctcatgttatatatgtggaggtaccagtgtaggtgaccaacggccctgggaggctagagaaataataccacaagataactttaccataccagaatttgttacaaagttcaattgaaacccaggtgtctggctattaaaaacccctatcattggaagatactgcatagcacaatggggaaaagactttcaaacccaagtaggagatatgacttgtttagaaatatgacttgtttaggtcagcagtattttgaagagtctaagaacaagacacagtggagaagctttatagacaatttctctaccatattttaactctctctctcagtttccagtgctaaatcagtcgtagtatcaactagacactccaaatgtttggaaagcaccggcaggactacattggatctatgggacaaaagcctattaactattgccagagaagtggaccggagcctgtattttagggacaataaggccgtccttcttcttgctcccactgaaacaaggggaagattttagttacccagtctataatgaagaaagaacaaaagaaatgtctttactcagataagtactgtagaaaacataagcacaaacataaagaaggacattgagataggtagctggaaagataaagaatggcttcctgaaagaattatcaaatactatgggccagctacatgggcccaagacagatcatggggctaccacacccctatttacatgttaaaccaaattataagattgcaagcagtactagaaatcatagtcaatgaaacagcctgagccttggatctgttagccatacaggctactcaaatgagagatgctacatatcaaaataggctagcattagaccacctcctagcctcagaaggaggagtctgtggcaggtttaatttgaccaactgttgcttacaaatctgtgataatggaagagctgttacggaaattactgctagaatatggaagttagcccatgtcccagtccagacttggtctgggtggagcccaaactcacattttagaggttggttctcatggtttggaggctttaaaaccttgataattggttttgtaactatagtaggaagatgtctaatactgccttgtcttttacctctcctcaacagaagcatccagtctactatggaagcaatagtggaccgaaaaactaccaccaaaataatggcattacaaaaataccaacctgtcccccaggaagaatatgagcctacacaggaagagataaatgattgtggtgctctttattaatctacatttatggtgagcaccaaaggtgggggatgaagaaggaattcatgaattttacaagtataatcaaagaccaagaaattttcactttttccctcaaaagctaagtgtagtgtagcccccactccctgtcccgtagtccaagttagagaagaatactaactgcctgtttttccttctgcgctcagcaagccttatctgtactcaccggtttcatattccttgaagctcagcgagttcctgcttcacctcaccagcacagctgcaaagttacaaggttgatacgcatatgttatagaaacatagtttcccaaggatgtggaacatgtagtatagataagtgtaaaagactgatcaactgcctttgttctcgcttctgtaagtacacttcctacatcatgtagctcccggccactgattgcttaaaatgtggctgtttctttgtctggagctcagaatttccttgatgctagtcctacttgagccagacggtcaccttaataaaggctttcctgaactctattcggtctctcccatctctgattgtcccacaacaccacctctcaggttcaagtgaatctcctgcctcagcctccggagtagcagggattacaggcaagcactgccacatccagctaatttctgtatttttagtagagacgaggtttcaccatgttggccagcatggcctcgatctcctgacctcgtgatccgcccaccttggcctcccaaagtggtgggattacaggcatgagccactgcgcccagcccaaatacttttttaaaagaagaagctggagactagaactaatggataaagtaaagggctactgctggggtgagattaacaagagcatactgcagacaggaaggaggaggaaattccttaatctgttatccttcctacagtcatcattataaaaatttaaaattaggccaggtgcggtggctcatgcctgtaatctcagcactgtgggaggccgaggtgggcagaccacttggggtcaggtgtttgagacaaacctggccaacatggtgaaaccccatctctactaaaaatacaaaaattaaccgggcatggtcgcaggtgcctcgaattccagctactcaggcagctgaggtgggagaattgcttgaacctgggaggcagaggcctcaatgagcagagatgtgcaccactgcactctaacctgggcaacacagcaaaactctgcttcaaaaaaataaaaattagtctgggcatggtggctcacacctgtaatcccagcacttttggaggttgaggtggttggatcacctgaggtcaggagttcgagaccagcctgaccaacatggagaaatcccatctctactaaaaatacaaaattagccacatgtggtggcgcatgcctataatcccagctacttgggaggctgaggcaggacaatcacttgaacccgggaggcagaggttgcggtgagccaagatcacaccattgtactctagcctaggcaacaagagcgaaactctgtctcaaaaaaaaaaaaatagaatgatattaaatgttaaaaatacaatgcttcattagctcacccaaaaaagattccaaagcacataagacaagcctatgccttatttgtaggcccttgacataaatgaagttaagggcaccaccacttagctttcacataaacatgggtcacaaaccactgttgacactgtgaaattctgtaattcctaagactctttcaaaaatgttgagggaattgaactatttcaacttttgagcataacatgagaatttatttgcaaacatgatttagaattcccttaaagtatgacaatttaaattcttttgaaatatgagagaatatatgttttctataggctcatgtataatggataaaatacaaggtaaaagttgaaaagagcctcacaaaactgatagcagtcattatctttgtggaagaggcaacactgggaacgctggtcaaaagagcttttgtacttacatgaaaaggcaatgcatgttactattacctgtgacagtgtaaattaataattttaaagaatagacaacacaaacctgatacatacactcacatttgggacagcaggagaggggacaacctaacatggctctttctctatggcatgggaacttcccctctctggttttcactcttgccatcttcaaactgggtcaatctactctaccacccagggttctgaaaataaaatgtaggagctcctagcccaaggcctacctagaatattgtaattcctcattaaatgtgcttaagtattgtatcagagttctccagagaaactaagtttgtgtgtgtgcatgtgtttgtacacttgcatatatgtttgtgtatatatttatgtgtgtatgtgtacacacacacacacacacacatatatatatgggagagatttattataaggaattgacttatgcaatcttgcaattatggaggttgacaactctccagatctgaaggatgatgagtccatgtttggggacccaggacagccaattgtgtagttccaggctgaaggcctgcaagcttgagatgcaggaagagcagatgtttcagttcaagtccaaaggcaggaaaaagctaatgtgtcagtaagaaggcttgttttactcaatccttcaactgaccagatgaggcccactcacatcaggaagacagtctactcagcctaccagttttgttttctcttgttttagtgggggcttttgctgtttttctttggggggggagttatttttagcataattgaactttttatgtttttaactttgtttgattttagatttgggggtagatgtgcatgtttgctacatgggcgtattgtgaactagtggggattggacttctagtgtaccccattacctaaatagtcaacattatccaaatagtgagccctcacccccttcccaccctccccccttttggagtccacagttgtctattatttccaaaacaaacagaaaaacattctacattcatggatatgaaggatcaatgttgctaaaatggccatactaccaaaagaaatttactttttaattcaatgttattcctatcaaactaccaacaacgcttttaacagaattttttaaaaatgaaaaatcttatttgaaacaaacaaaaaagaggctgaatattcaaagctttctatgcaaaggaacaaagctggagtgatcgtactactcaatttcaaactatactataaggctacaatacctaaaggagcatgggtactggtacaaaaatagacatatacaccaatggaacacactagagaacccagaaataaagccacacatctaaaaccatctgatctttcacaaagtcaacaataacaaacaataaggaaaggactccctattcaacaaatagtgctgggataactggctagtcatatgcagaagattgaagctggaccacttcattataccatatacaaaaattaactcaagatggattaaagacttaaatgtaatatttaaaagtgtaaaaaaccctagaagaaaacccaggaaatatcatgctgtacattggccctggcaaagaattcatgacaaagactctaaaagcaattgaaacaccaccaccacaaaattgacaagtgagacctaattaagctaaagagcttctgcacagcaagagaaactacaaacagtaaacacgcaacctacagaatgagagaaaaaacttatgtatccagcaaaggtataatagctacaatctataaaaaaaggtaactcaacaagcaaaaaacacacaaccttatttaaaaatgaaaaaagaacattaacatacacttctcaaaagacacacatgtatccgacaagcatataaaaatactcaatatcagtaattatttaaaaaatgcaaatcaaagtcatgagataccatctcacatcagtcacaacagccatattaaaaaggcaaagaataatagatgctggtgggtagtgaatagtaaaagcttatacactgccagtgggaatgtaaatttttcctgccactgtggaaagcagtctgaagatttctcaaagaatttaaaaccaaactttcatcagacccagcaatccaattttttggtatataccccaaagatagaaatcattcaactataaagacacatgcatacttatgttcatcacagtactatttacaatagcaaagacatggaatcatctgatgtccttcaatagataaatggattttacaaatgtgatatatatgtatacacacacacacacacacacaatgaaatggtattcagtcactaaaaaagataaaattctgtcctttgcagcaacagggatgaacctggaggacattaagtgaaacacaccaggcataaaaaaaaaaaacactacacattctaatctatagaatctaataaagttggtatcattgaagtagagagtagaatggtggttactagaaactagagtgtgtaagagagtgcaaaacggggagaaaatggtcaatgggcaataagttacagttacatagcaggaatatattcaagtgcacagtagggtgacaatggtgaacaattttgtattaaatatttcaaacggctagaaaagagaattttgaatgttctcaccacaaagaaataacatgagatgtcaaacatgataaatcccataatttattacatatatatacacatatctaatgctcacattatgctccatctgtatgtaaaattactgtgtcaattaaaaacaaaattaaaggccaggcgcggtgactcatgcctgtaatcccagcaatttgggagacttaggcgggaagatcacctgaggccgggtgtttgagacctgtctggccaacatggtgaaaccccatctctactaaaaattcaaaaattagccgggcatggtggcaggcgtctgtaatcccagctacttgggaggctgaggcatgagaactgcttaaacctgggaggcagaggttgcagtgagccatgatcatgccactgcacgccagactgggtgatagagactccatctcaaaaaaaattatagaaggaaaaaatgaggtcataaactaaccatctgtccccagattgtatggaaagacatacaaataaagataatgacaactcaccagaagaaaaacctgtaagaaaaaacttcagtagcaattagtactatggtagaaaacctacaccgtaattgaggagttgctgaagcctaagagtggaaaagtttgagagttaaaatctccatggaggccagtcttagttcctcctcacttttgagagttttattttcagaagccttaccagattctcacagtagaaatagaaaaatcttttctttctggcatagggaagggaaatgtacccttctaaaagccactcagggcattctgttcttcttaccaagctctgccatcattaaactattttagcaaagcctgacttactggggttttgtctgagtttatatgacctgaggtaagggaaatacccatcaccaaactgctgcagtattcagttgggaagaagagaaatattcaatttcagaccacttgagcccttcatgtgagcaaagggacatacccaactcccattctctctagccttcctgttagacctaagaggatgggaaatgtgaagcattttctaagataacaacacaggcacagactcgctaaaagacacaacactcacagtggttggaatgaacatatccatctgttctcaataaatgtacttggacaaactgatgggagcagaggtaataagcaacctacattttcctccctgtatctcatgttctgtgtcaacagatgtgtgctctggaggacagagcagttctcctatgtttctttaaaagaagtaagatttttctgactcccaaagtaattttgatctagttccattctgaaaactaaaatccactaaggaacatatacaaagaacaccacaaatcacccgtacggaactcacagggacacattaggaaatgtgacactgggttgtactaattttgaaggctgtatcattgggagttatactttgttgacaacttctgagaatatacaatccactaggcagaagctacatagaaaaatgagctttgacattaaaatgtctgaaatccagatggtacaacaaaagtttcaaaattgtatactctctacagcatgactgtgaatgtgttattatatatataatatatatatatattatatatgttatttgatgtggcaatgagtgaggaggctggattacccagaatgtatatgagataatcagagttaaccacgaagtgggtaaaattaatatgaagatggtaatcatttggaacactaaagaacactgataatgtgagatctattgtttttcccagatacaagaaatacgtttgttattaagactaacacgctttcctcttctgttatgcttaaaaatgcctctttttttccccaagcttccactggactttgacccaacacctttttttttcttcaacatcttcacattcctttaggatcacagatctaagcaccatggcctgatcagctatcacttggccttcattaatattcctcactgtggtggatggttggtctccaggtatgcttgaatcactgcacttagagaatgagttcaaacttaagtccttgttctacataaacagagtgaggatggcctatgtatctgtaacacctgtctcctgagtgtacacccagccagcaccatcagccccagcaactgccagttggcaaggtttaaacagaaattcacaaataacattatcactgtcatctctttttatttttttatttttattttttggtcagtttgtctttcagtagtgatataatattcttcactgtggcttcttccaatgtgatgcataccagtctacttaaggtcagcaaatactgttccctttctcccatgaagtcctttttttactctgacattatccggggatgtcttcattataggaattacactgcattcaatcacacacatggtgatctttttgtcccagcatcagaggcaatcccagcaccttcacagcaccaggatctctccaagagccttcccagagaaaagggccattcagaccatcctgctgttagtgagctactttgggtgctgggtggacctcatcatatcatgctcttcaaccctgctgtggacatataacacagtcatcctgagtgtgcagaaccttgtgggcaatgtctctgccactgttgttccactggtacgaatcagctgataaaaggatagctgacattctccaaaatatgcaaagtgctataaagatttaacgagttagcaatggaaaacatttctaaaagaacagtcttatcctataaattgttcaagtagccttggaattctttttatcttatttaataaattgcatggaatcacacttttattaatatttatatgctttcaaaactgatgcatccaagaactatgtaatttctttagttcaatgtctaccatgggtagacatttccatatcaagtctcttacacttttattttcattttatcttggtagcagaaaatgtttctctcgaagtatactcttaacaatcttctatcggtaatcaaatctctcaaagtttttacttctgaaaaaatttaatttactcttatttatgaaagacactttagctaaatatcaattttagcttttatactaagcttgttcattagaacttccctgactggaaataatatgtcaatttggattttacatttaatctataatttattttaaagggattaaaataaaatttacatgtaaatagttgttcttctttattaatgaaatttacttatacattaactatagcctccatgctgtacattaggtctccagtccttattcatattataaaacaggtttgtaccatttgaccaatatctgattcccccaagacacagcccttggtcacttgcattctattgtctgtaactgtaattcaaacacttttttagactccacatatgattgaaataatgcagtgttcatctttctgtgcctggtttatttcacttagcctaaagacctcaagatgatccatgtggttgcaaatggcaaggtttttttcaagacctgaactgtgacacacacacgtgcacacacgcacatacctatacctatacacatacatatatatatatatatatatatatatatatataatttccttgttgttgttgttgttgttgttagatacaacaggctggagggcagtggcatgattatagctcactgtaacctctgaattctgggttcaaattattcttccacctcagcctccaaagtagcaaggaccacaggggtacaccaccatgcctagctaatttgtaaagacatggtcttgctatgttacccaggctgatcttgaactcctggcctcaagtaatcctactccctcagtatcccaaagcactgagattacaggcttaagccaccatgctcagctatataatattttacttacttctgtgttaatggacatttaggttgttttcatatcttatctattgttaataatgcttcaataaacataggagtgaaaatatctcttcaagatagctattttatgttccttggatatttacttagatgtaagattgatgactcatatgacagttctatttttaattactcgatgaacctccatgccgttttccataatcgctttaccatttacattcccagtgatagtgtacaaaggtcccttttctctacattcttgacaacacttgctttcttttgaatttttgataaatatcaccttaatctttgtttgaatgcgatctcattgtggttttgatttgcatttttctcctaattactaatggcttctttaaataaataacctattagtttttggctactttttaaaaaaatgtatcactttttattgttacttttatttcggggtgttaagttttatgagtttctggcagatttcgaatactaatcctttatctgatatttggcgtacaagtatttttctccaattctgtaaatagccttttaaagacactgaactgtcttttgctatgcagtagactttttagtttgatgaagtcccacttttttccctgtgcttttggcgtcaaatacaaaaaaattatggctaggaccaatgccaaagcattttcctcagtgttgtcttctacaagatttttcgtttcaagtccagtgtctacgtctttaatgtattttaaattaactttatgtatgctgtaaaggctgggtgcaatttgtttttgcatgtggatatcgcattttcccatcaccatttactgagcagtttttttctttttccattgtgtatctttatgccattgttgaaaattcattgactgtatacagatggagacatctgatatatatatatatatcgatatatatatatataaatacatatatatatgagctctctattctgttccagtggtctatgtctttgtgtttatgccaatattttgcagttttgatgactacaactttgctatatagcttgaaatcaggcagtgtaatagctttgtccctcttgctcaaaattgctttatttgagtcttttataattccatacaaacagtagatttttaaaatttttgttgaaaatgcaattggaattctgatagagattgctttaaataatacatcaattttagtatgaatgttttagtaataatttttctgatccatgaacactaagtatttttaaatttatcttttctataattgcccccattaatattttacagttttcattatacaaatcttttaccttattatatttattcctaagtattaggttgctgcaaatgtaattgtggtttttgccattaccaatccaatactttattctttctcatgttacagtaaatgtaactgtcttcttgctttttcccagatatttgttgttggagtataaaaatgcaattgattttctttacattgatatagtatcccgcaaagttccttagtttaccagttctaaatttttttcatgtcatgatgagcacactggcctgtgtttacacattaattgacagtttctattaatctatcacagagcctaaaagtgtgctctgttgtatttttgctgtgacaaattccatggcatcttttagtcttaatctttttttaaatgcttttgtttggtacttgataataaggtgtgtctttgtttacttttcaattgtgaaacacatttatctccatgcctagtcaaactttctaataaagttctctaatagttttatgtacatttagttattataaatcaaaatagtaaatttttatgatagtttcaaagttactaagattgaaaatgtcaatttttcactgctcatgaatctgcggtttccttattttaaacaattatgtatgatgtctatatatttgtgtgtgtgtttaatggcttacaatcttgcccaacatatttgtatgtagtaagcaagtactaatcaaattaatcaaactatcatcttgatactattcttcaaatggcatattatgtttgttctaattaaaaactgtgttcatgtcttatataattatcaaaaaaattagaaagtctactttgtctgccctcttgagaaaatccaaagttaaatggtagttttactaatttcctttagaatcactaccttattttcctcacacaataaatgtaaacattattgggtgaagtcaagatggctgaataggaacagctccggtctatagcttccagcatgagcgatgcagaagacggctgatttctgcatttccatctgaggtaccgggttcatctcactagggagtgccagacagtgggtgtgggacagtgggtgcagcggactgtgcacgagccaaagcagggcgaggcattgcctcattcaggaagtgcaaagggtcagggagttccctttcctagtcaaagaaaggggtgacagacggcacctggaaagtcgggtcactaccaccctattactacgcttttccaacgggcttaaaaaatggcacaccaggagattatatctcgcacctggctggaaggtcctacgcccacggagtctcgctcattgcgagcacagcagtctgagatcaaactgcaaggcagcagcgatgctgggggaggggcacctgccattgcccaggcttgattaggtaaacaaagcagccaggaagctcgaactgggtggagcccaccacagctcaaggaggcctgcctgcctctgcaggttccacctctgggggcagggcacagacaaacaaaaagacaagagtaacctctgcagacttaaatgtccctgtctgacagctttgaagagagcagtggttctcccagcacgcagctggagatctgagaacgggcagactgcctcctcaagtgggtccttgaccccggagcagcctaactgggaggcaccccccagtaggggcagactgacacctcacacggccgggtactcctctgagacaaaacttccagagaacgatcaggcagcagcatttgcagttcaccaagatccgctgttctacagccactgctgttctgcagccaccgctgctgatacccaggcaaacagggtctggagtggacctctagcaaactccaacagccctgcagctgagggtcctgtctgttagaaggaaaacaaacaaacagaaaggacaaggacatccacacgaaaaactcttctgtacgtcaccatcgtcaaacaccaaaagcagataaaaccacaaagatggggaaaaaacagagcagaaaaaccggaaactctaaaaagcagagcgcctctcctcctccaaaagaacgcagcacctcacccgcaacggaacaaagctagacagagaatgactttgacgagctgagagaagaaggcttcagacaatcaaactactccgagctacaggaggaaattcaaactaatggcaaagaagtaaaaaactgtgaaaaaaaattagacgaatggataactagaataaccaacacagagaagtccttaaaggagctgatggagctgaaagccaaggctcgagaactacgtgaagagtgcagaagcctcaggagccgatgcgatcaactggaagaaagggtatcagtgatggaagacgaaatgaatgaaatgaagctagaagggaagtttagagaaaaaagaataaaaagaaataaacaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagatttaccaaagttgaaatgaaggaaaaaatgttaagggcagccagagagaaaggtcgggttatccacaaagggaggcccatcagactaagagcggatctcttggcagaaactctacaaaccagaagaaagtgggggccaatattcaacattcttaaagaaaagaattttcaacccagaatttcatatccagccaaactaagcttcataagtgaaggagaaataaaacactttacagacaagcaaatgctgagagattctgtcaccaccaggcctgccctacaagagctcctgaaggaagcactaaacatggaaaggaacaaccagtaccagccaccgcaaaaacatgccaaaatgtaaagaccattaaggctaggaagaaactgcatcaactagtgagcaaaataaccagctaacatcataatgacaggaccaagtacacacataacagtattaactttaaatgtaaatgggcaaaatgctcccattaaaagacacagactggcaaattggataaagagtcaagacccatcagtgtgctgtattcgggaaacccatctcatgtgcagagacacacataggctcaaaataaagggatggaggaagatctaccaagcaaatggaaaacaaaaaaaggcagaggttgcaatcctagtctctgataaaacagactttaaaccaacaaagatcaaaagagacaaagaaggccattacataatggtaaagggatcaattcaacaagaagagccaactatcctaaatatatatgcacccaatacaggagcacccagattcataaagcaagcccttagtgacctgcaaagagacttagactcccacacattaataatgggagattttaacaccccactgtcaacattagacagatggacgagacagaaagtcaacaaggatacccaggaattgaactcagctctgcaccaagcagacctaatagacatctacagaactctccaccccaaataaacagaatatacattcttttcagcaccacaccacacctattccaaaactgaccacatagttggaagtaaagcactcctcagcaaatgaaaaagaacagaaattgtaacaaactgtctctcagaccacagcgcaatcaaactagaactcaggactaagaaactcactcaaaaccgctcaactacatggaaactgaacaacctgctcctgaatgactactgggtacataacgaaatgaaggcaaaaatgaagatgttctttgaaaccaatgagaacaaagacacaacataccagaatctctgggacacattcaaagcagtgtgtagagggaaatttatagcactacatgcccacaagagaaagcaggaaagatccaaaattgacaccctaatgtcacaattaaaagaactagaaaagcaagagcaaacacattcaaaagctagcagaaggcaagaaataactaaaatcagagcagaactgaaggaaatagagaccaaaaaaacccttcaaaaaattaatgaatccaggaactggttttttgaaaagatcaacaaaatcgatagactgctagcaagactaataaagaagagaagagagaagaatcaaatagacgcaataaaaaatgataaaggggatatcaccagcgatcccacagaaatacaaactaccatcagagaatactacaaacacctctacgcaaataaactagaaaatctagaagaaatggataaattcctcgacacatccaccctcccaagactaaaccaggaagaagttgaatctctgaatagaccaataacaggctctgaaattgtggcaataatcaatagcttaccaaccaaaaaaagtccaggaccagatggattcacagccgaattctaccagaggtacaaggaggagctggtatcactccttctgaaactattccaattaatagaaaaagagggaatccttcctaactcattttatgaggccagcatcatcctgataccaaagccgggcagagacacaaccaaaaaagagaattttagaccaatatccttgatgaacattgatgcaaaaatcctcagtaaaatactggcaaaccgaatccagcagcacatcaaaaagctgatccaccatgatcaagcaggcttcatccctgggatgcaaggctggttcaacatatgcaaatcaataaatgtaatccatcatataaacagaaccaaagacaaaaaccacatgattatctcaatagatgcagaaaaggcctctgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaattaggcaggagaaggaaataaagtgtattcaattaggaaaagaggaagtcaaattgtccctgtttgcagatgacatgattgtatatctagaaaaccccactgtctcagcccaaaatctccttaagctgataagcaacttcagccaagtctcaggatacaaaatcaatgtacaaaagtcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattctatgctcatgggtaggaagaatcaatatcgtgaaaatggccatactgccctaggtcatttatagattcaatgccatccccatcaagctaccaatgactttcttcacagaattggaaaaaactactttaaagttcatatggaaccaaaaaagagcccggatcgccaagtcaatcctaagccaaaagaacaaagccggaggcatcaagctacctgacttcaaactatactacaaggctacagtaaccaaaacagcatggtattggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggttaatatccagaatctacaatgaactcaaacagatttacaagaaaaaaacaaacaaccccatcaacaagtgggcgaaggacatgaacagacacttctcaaaagaagacatttatgcagccaaaaaacacatgaaaaaatgctcatcatcactggccatcagagaaatgcaaatcaaaaccacaatgagagaccatctcacaccagttagaatggcaatcattaaaaagtcaggaaacaacaggtgctggagaggatgtggagaaataggaacatttttacactgttggtgggactgtaaactagttcaaccattgtggaagtcagtgtggtgattcctcagggatccagaactagaaataccatgtgacccagccatcccattactgggtatatacccaaaggattataaatcatgctgctttaaagacacatgcacatgttatgtttattgtggcactattcacaatagcaaagacttggaaccaacccaaatgtccaacaatgatagagtggattaagaaaatgtggcacatatacaccatggaatactatgcagccataaaaaatgaagagttcatgtcctttgtagggacatggatgaagctggaaaccatcattctcagcaaactatcacaaggacagaaaaccaaacaccgcatgttctcactcataggtgggaactgaacaatgagaacacatggacacaggaaggggaacatcactcaccggggcctgttgtggggtgggggcaagggggagggatagcgttaggagatatacttaatgttaaatgacgagttaacgggtgcagcacaccaacatggcacatgtatacatatgtaacaaacctgcacgttgtgcacatgtaccctaaaacttaaagtataatttaaaaaaagaggaaaactacttgaataagcttcttttgctgtttttataaagcaaaaaaaaaaagagattcactatcagtagaactaatacacaaatttatccgtgttacaagacagaaaactggcatgccaaagtagattatggtttatataaaagcaaccaacaattaaaaataaaataaagaaaacaattccacttataatggcatcaataaaaaacattaagagaaaaaaattcaagacagatacaggaattttacacaatttgtaacactgaaagaaatcaaagataaactgaaaaataactggaagtcattttatgttcaaggatggactgtttgtaaggcaaaggttacatgtttgaggggatggataccctaccctccaggatatgagtgattattatgcattgtatgcctatatcaaaacatcccatataccccatacatacgtatacctacaataattttttaaatacttattattcttaggataacaataccctataaattgatttgcagattcaatataatcccttcaaatttccaagtgtatttttttagaaattagaaagtctctcactcccttaaatcaatatgtatgtacagaaaatcaaattgcacaaaacaatttttaaaaagaaaaacagaatcaaatgacttatacttcctaatagcaagtcttactagaaaggatagagtacaattccgcagtttcttcacattttccatctgttctgaccaagaatacacagacgcttgacttctctgttattctgtggcccggatacctgcatgctttcccctgcagacttgaacccaagccagggctctgaacattcgcagacataagtaaaggtgttgtgtttaggttgtaattcaaaacactaaaagaaagtatccctggtcctgggagattccttaaacgctcctataaactgcataaccagactcctcactgcaaagatacctagacaaagcatccttggtctcctttcctcccaataagatgagctgcagccctcactgtgtgtacatcccttaagaaatgctttgggctcatcataccagggtttagagtttacttctttggaatcctaacccccttcatctcaggacagtctgggacagtcccttgtgaaaattcctctgtgatcacctttggggcaactccagctaagtgctgagctggaggaagaagtagggaagtcagcagagttttaaggaatgggctggggaaaagaggatcccattcggagatcctgagatacctgtaagggtctacgtgggctttgttgcctgcccctccctgatgtccgcgagctgccccagagatgctgagatgctccaaaatctccagcaggatacaggagggtgatggagggtctgaaattgcaaaggatcagtaaggaagtctggtgcttggatatagagggacaggactggttggcatcagccatgggcagcctgcatagaaacaggctaagctggaggcccagagtaaggtgtgcaaggccctggggaaacaatgatgaatgatatcctcaagggacacagggtctaacagaagatagaattttacagaaagatgattctggcttctctgttctatgctggagtagaattacataccagggaccaaggtgggcaaatatggagtgcctaactctgggtatgggagtctgagaaagtttcccaaaggagaaggcagactcatagtatcagtgaaaaatgctttattaaaagtggctgccaaacggagagagagatctgccctctcagggagttggggtgatggtgggagtggtggtggattctgaaaagcttcacagaaaaattgatacgaaaggctttgcaggattatgaggggtgtgtaatcttgaaatgcagagggaaccagactggcaaatgtttggtagcacagaagtatacagcgcctttggtaaatgatgtgtagtacagtggctagaatgtaggtgtaggatggaagtccaatgtagtgcccgagtgtagagggctttgaattttatatgaaggagtctgactattacagcaggtacttgaataatgtcatttcgttcagtatcatttcattgtaatgttgataagaaaaaacaatcaactcccagctggccacttcctgtgtgtcctttacacattctccccaggtccacatgggttttcactgggtactcccagtttcctcccacatctcaaagatgtgcccattatgtgaactatcatttctaaatagtccccatttgagctctgtgtgtgtgtgtgtgtgtgtgtgtgtgtgtgtgtgtatgtacactctgccatatgatggcaccctattccagatccagggctggttctgcctagcgccctgagttgctaggagagactccggccacccatgacccctagctagaataggtgggtaaataataatcttacttgtttttatcactgataaagggagttttttcctgctttgtattagtcgcaaagcaagaaaacccaatcagaaacaaggccaagtgggttttttccctgcctgggatggagaagaaaagagttcttgctctaaagacaccctttccctgaaaaatggaaggcatggagtttttaagaactaggtacggggagggagaacaacgttagcatgagcagggtggaactctaggtgcacaggttcagtgcatataaacatacatctttatacaactcatgtcacaaaatggcaagattttctttggcagagggaattttagtatcatagtgatatgttaatgatctaggccagaagcggtggctgacgcctataatcccagcactttaggaggctgaggcatgtggatcacctgaggtgaggagctcaagaccagcatggccaacatggtgaaacccagtctgtactgaaagaaaaatacacaacaaaattagccagataagttggcatacacctgttaattccagctactcagaaggctgaggcagaagaatcgattgaacctgggagccagatgttgcaatgagccaagatggtgccactgcactccagcctggacgaccgagtgagagtctgtcaaaaagaaaaaaaaaaaaagttatctaaaagcaactagggctcacctgttcgagtttgtgctggttggggatcttatctcctggtatgtggtcaggggtggagaagccctggtgctggtgggccaactggtttctttatgcagctatgcctacaaataaagaaactaaagaaacacagtaataaatagatctttcccagttatttcatcagggtggccctggtaacatttttattaatttttctttatcttttttggggggggggggcggtggggagatggagtcttgctctgtcacccaggctggaatgcagtggcacgacttcagttcactgcaacctccacctcccagattcaggtgattctcccgcctcagcctcccaagtagctgggattacaggcacgtagcaccatgcccgggtgattttttgcatttttagtagagacaaggtttcgccatgttggccaggctggtatcacactcctgacctcaagtgatcctcccaccttggcctcccaaagtgctgggattacaggcgtgagccaacacgcctggcctaatgtatgtagagctcacatttttcttaaatgtatgtagagctcacatttatttcagtatttaatactggaagtgttttaggcctttctaagtttggtgatgttcttgtgaccagaaatatgccatagaaacttaactatttctatcaattagactatggtaaggttggcttaattgtaggtcacagttttcaagaatgtattaaatcctcacactaagtgagaacttaactgtattcagcaggcaatggagagtcaggaaagtttaagcaaaaatgtgtaattattctaccagaaaatatttgataagacataattttatgaaacatcaggtttataacaaagttattaaattatgtacatattagggttgtgaagataaaggccacataggcccatttcaagtcaacacataaacatagaaggatgattaacaaaataagcgtgtagcttatgctaaatgttgattggaatagacaataaattatggagaacttcacaggatactaagcttggatgggatcttagaagttttacaggtcaatgccactccatctactggctgatttgcactagtttaataaatgaacaacaaagataacatgtatcagtaaaagttaaaatcattttattgaatatctgtcatgtctgtgccattgtagtgtactaggtgccttataccacttatgagtcctctacttacaaaacgcttttcacaaaatatgagtctccaaagtcaatggcatgaatagttgtggtccagacatatgatgtttgtttttaaaatctttacacagccttgtatcctttttccttttcttccttttaccctttttaaaatgtgctgagttttatctaaggctaacctctgtaatgttgctatatgccagtattcagttactgtgtttgatgaatcataaaatggtgtgaagctttaattagtgttctttttaaataaaatgctgtttatgaatgcatccatcaaaatgcttttgatttgggtattcacaaaatattagttttctgtggatctaacaataatgcaaaaatccaaaatgaatataaaatattagctaatatatatttcaaagtattctacaagtataaaaactattgtatgacattactttcatatatgtaaaaaataatttttagtcaacataaacatactccttatatctaaacttgtattaattcatttaagagttaatatagtattgtaaagtcatcaaatatttaaaaacaaaatgtattttgacttagaatatacataaaattaactattttcagctgagtccagtggctcatgcctgtaattccagcactttgggaggccgaggcaggtcgactgcatgaggtcaggagtttgagaccagtctggccaacatggtgaaaccccatctctactaaaaatacaaaagttagccaggcttggtggagcgtgcctgttatcccaactactccggaggctaaggcaggagaatcacttgaaccccagaggcagaggttgcagtgagccgagatcgtgccactgcactccagcgtgggtgacagtgagattccatataaaagtagtaataataataataataacaattttctgtgagtcccaagataaaatagcattacagaacactgaataatcctgagtttggttttcttggttgcattctgctttatatttagttttgttcaccttgaccagtgggcttgtggttcttaggtgcaacagggttttcatttttaggttcaagattttaaagctttaatgtggtaatttctctaatttttttgacagttatttctcaggttacaagttaaaataaaatttccatttcactgaagtctttggtttattaatgatttcatgacttaatatacaatgagtaataaggggtgctacaaattttcagaaatcaacactaaataacttactcatggaagcaaacactacctgtttcccaaacacctattaaaatacaaaaatttatcaatagtttttaaaaataactaaaaatgagaatgaaaaaacatatatccaggttaaaaaaaactgtatttcaattaaatgacaagtaatttttggggggtctcagcgctactacaaaattatttgctgtttattataactaataagacagctacaaaataattttttaaaatgaagaaatagtaagtacaaaaaagatattaacaaatattggtatattggtgaaggctggactcagtggctgttttccaaagtggttataccagtcgggtgtggtggcacacacctgtaatcccagcacttctggaggcagaagcgggcaatcacttgagctcagaagtttgacctaggctacatggcaaaaccctatctctaccaaaaaatgtaaaaatcagccacacatgatgacaagtacctgtaagtcccagctacttgggaggctgaggtgagaggatcacttgtgcctgggaagtcatggctacactggccatgttcatgccactgtactccaccccgggcaacagagcaagattttgtctcaaaaaaaaaaaaaaaaaaaacagttggtgacaatgtggaagaactggaacccacacacattactggtgggaacataaaatggtgtcatcagtttgggtgtttcttttctggtcaattgatttttttaaaaatcaagatattgtctccctatgttgcccaggctggtcctgaagtcctgggctaaagcagtcctccaaactcagcctcccaaatagctgagattaaaggcatgagccaccatgcctgactggtgtaaccactttgaaaaacaacgtggcagtttctccaaggctaaatgtatagttatcacataatgcaacaatttcatttctgggtgtaaatccaagagaagcagaaatatatgttcacacaaaaacttgcatgtgagtgttcatagcaccattactcatgacggtttatatgcagaaacagcacaaatgtccatcaactgatgaatggctaaacataaactattattcagcaacaaaaggtaagaaatactgatgcacactataacatgaaagaaatttgaaaacattgtgctaagagaaaaaaaagcaaactacaaaagatcacatactgtacaattctatttctattaaaggtccagattaggcaaaactacaataaaagaaaataaatcagtggttgcctatgaagacacaggaacgtgggggaagtaggaggtagcagctaagaggtgagggtttctcactcttaagtgggtaactcataaatgggtaatcgcttctaaaagtgactgtggtgatggatgcacagcttcatgaatattctaaaaactactgaatttctctctttctttcctttctctctctctccgtctctctttacttctttcctctctcactctctctctttctcgacatggtctccttctgtcacccacactagtgcagtaccgccatctggtctcactgcaacctatatgccttctgggcttaagtgatcttccagcatcatgtcctcaagtagctaagactacaggcatgagccaccatatccagctaatttttgtattttttctagagatgctgttttgccatgttgcccaggctagtctcgaactcctgaactcaagcaatccacctacctcagcctcccaaagtcttagcgttataggaattagccaatacacccagcctgaattgcacactttgataaatgaattgtgtgagatgttaatcatatttcaattaaattattattataaaaagggccagatgcagtggctcacacctgtaatcccggcactttgggcggccaaggtgggccaactgcctgaggtcaggagttcaagaccagtctggccaacatggtgaaaccacatctctactaaaaatagagcaaaaattagccaggtatggtggcatgcgcctgtaatcccagctactcgggaggctgaggcaggggaattgcttgaaacagggaggtggaggttgcagtgagccgagatggcaccactgtactccagcctggacaactgagctagactccatctcaaaaaaaaaaaaaaaagaaaatgggggttgagcacaggtggctcaggcctgtgcataattccagcactttgggaagctgagacagagagatcacttgaggccaggagtttgacaccatcctgggcaacatagcaagatcccatctcaacaataaaaaataaagaagttagctaggcacgggggcaaacgtctgtagtcccagctacttgggaggctgaggttggaggattgtttcagcccaggggtttcaggctgcattgagacataatcaagccactgcactgcagcctggtgacagagcaagagcttgtctctaggaagaaaaacaaaagtaatgcaagttttcgtcaccttctgagagtaatcgactttcaggaggactagaaaaacaaaaaaaaggaccactgaatggttgagggtgtgttcctggttaggctcagttgctggctgagtagtatctgaaaaattaattagtaaaattacagctctagggatcagtcatgcagtcaccatagccaggactacaagtgagcatcacaactcccagctacttttttttttttttttttttttgtggagacagaagccttgctatgtgcccaagctggcctcaaaactcccaccctcaagagatcttcccacctcgacaaccagagtaactgattctacagacacatgccaccgtgtctggataattatattttattattatttatttgtgtagagaggagatcttgctatgttgccaagggtggtctcaaactcctggacttaaaacaatccccccatctctgcctcccaaagtgctggcactacaggcataagccactgcaccagcctgacttaaggtttccttaatctagcaacccatacttcatataattgggaaaggcagtactgtttttttttttttaattacttagtatttcaacaagaatcaaccatctctcagggccaggcacggtggctcacgcctgtaatcccagcactttgggaggccaaggtgggtggatcaaaaggtcaggagttcgagaacagcctggtcaatatggtgaaaccccgtctctacaaaaaaatgcaaaaattagccaggcgtggtagcaggtgcctgtagtcccagctactcaggaggccgaggcggaagactctcttgaacctgggaggtgtaggttgcagtgagctgagatctccccactgcactccagcctgggcaacagagcgagactccgtctcaaaaaagaaaagaaaaaagaaaaaaaaagaatcagccatctctcaccattgccatgaccctggtcaaaaacacttatctcccatctggatgttgccacagcttggcctccctgcttctacccaaatcttcccacaatctttctcaactcagcagccaagggatgcttttaaatcaggagacagatcatgttgcctctctgctcagaaccctcccacagttccgatctcagtcagagtaaaagccaaagccccagcaagagcctcccagagattacacaatctttactgatcagacacaccatggagttccctcctagcatctttatcctgttgtttctgcctacaatgctctcacctcagcaccttggccagttgcttcccccacttcaagtctttgataaattttcacttagggcaaccctggccactctatttaatattgccatctgtccccattcctgccatgctcttttttttccacaaaatctcgctgtgccactcaggctggggtgccatggcacaatcacgactgagacctcgaactcactggtgaagcaatcgtcctgcctcagcctctctagtagctaaagactacaggtgcatgccaccacacctgctaattttttaaaaaatatatggagcatcactatgctccccaggcttgtcttgaactcctgggccaaagcgatcctcctgcctcggcctcctaaatacctggaattataggtgtgggccaccagccctgggttcatgttcatttcttcttgctgctgttacaaactgccctacattgagtgccttaatacacgacaaatctactacctaacagttctgggagccagagtccaaaataggtcaattaaggctaaagtcaacgtgtcagcaggactgcattccttctggaggctccagagaggatgggttcccttgcctttctcagcttctaaaagccacccccatttcttggctcatggcccctaactgcatcttcaaagccagaagcgaagcatattcaaatctccctctctgacctctgcttccatcatcacatctcctccaattctgagtctcttgcctccctctttctcttataaaaacccttgtgactgctggacacagtggtcgtggctcacacctgtaatcccaacagtttaggaggtcaaagcggggaaacacctgaggccaggagctcgacaccaacctggaaaacatagtgagatccccaactaaacaacaaaaaccaaaagaaataagaaaagaaaaaattggctgggcatggtggtatgcatctgtagtttcagctacttgagaggctgaggtgaaagggttgctttagcccaggagttcaagaccagcctcggcaacgtaacaagatcccatctctaaaaaaaaatacaaaaattagctgagcatggatggtgtgcacctgtagtcccacatacttagaaggctgacgcaggagaattgtttgagcccaggtggttgaggctgcatcactgcactccagtatgggtgaaagaaagagactctgtgtccaaaagaaaaagaaaagaaatacacatctggtttctgcccctggtcctggcacaaagcttctaaagttctcataaagttctcagtgataaagttgataggagcatcttttgtttcaatatttggtcttagtcccaggtttctaacacaagaccctctaagacctttgggatctccaccatagtaagaatgcatttgatgatgctactgagatgactgggtgactgaaagctcccagacagcttcaggaggagggctggttgccagaacaaaccatgtgattagaggcttgaaacttgcagcctcacccactgagctccaggaagaaatagtggctgaagattgacttaatcaccaatggtcaatgattttatcaatcatgcctgtgtaatgaagccttcagaaacaccctaaacaacagggtttggagagtgtctgggttcctgaacacaagggggatactgggagggtaacatgcccaatagacggcatggaagctctgtgcccctctccacataccttgccctgtgcatcttttttctttcttttttttttttttttgagacagggtctggctctgtctcccaggctacagtggcacaatcgtggatcactgcaacctatgcctccctagctcaagccatcctttcacctcaacctcctgagtaactagaattgtaggcacatgtcactgcaccaggctaatttttataaaattttttttgtaaagatgaggtttcaccatgttgcccagcctggtcttaaactcttgagcttaagcgatgctcccgccacagtctcccaaagtgctgagattacaggcatgagcccagcatgtacacctctttcactggctgtttctgagatatatcctttacaatgaaccagtaatagaaagtaaattggtgagacccagtggctcacgcccataatcccagcactttggaggttgagatgggaggataatgtgagcccagaaatttgagaccagcctgggcaacataacaagaccccatctctacaaaaaataaaagaatatagccagatatggtggtgtaggcctgtagtctcattgggaggctgaggcaggaggatcacttgagcccaggagttcgaggctacagtagctttgatcacattgctgaattccagcctggcaacagagtgagactatgtatctcagaaaaaaaaaaaagaaaataacctgtttttctgagttctgcaaactgttttagcaaatgattcaaccaaagaaggaggtcatgagaccccagtttctaactggttggtcaaaagtacatgtaacaacctagggtttgcaactggcatgtgaagtgaggatagtcttgtgggactgagcccctatcctgaggggtctgcactaactccagttagtgtgagaatggaactgtgagatacccagttggtatccagattgtccgaaaactggtgtagaatctctgcatttggttggatgtatttgaccacagctactattcaggaaaaagaactactcattataaagaaaaaaccataaaattatatgttctacaaaaaacaaatcaaccttaactacagcccagtcctactcaaatatagactgttagaacaaaaggtctcaccatggactcgagagctgacatgaggaatgtcacaaacatcccgctctctgagaactcctcatcttcaacgagcggggggacactgcaactttggccatgatccctgcgcaagaaaagtagtaagaaagtgagtggtagaaatccagtgtcttaaacccatatccagagctgtgagagttttttttaccagctggctaatttacacttgtcttgcatcagaggaaaattaaggctcagaaactagatattcgatttgtccaaaactctcatcagatacagaatccatccgctaactttctatctggcattatttccataaaattagaacagtatcactcccaaaataaatccatatggcacccagcatcaatgcatttctcccaagtaaaataggaggcaaggcgctttacaacccagcgacgggctaccacaacacaggaaagaggtgccaacctccctttctcccctgcacaacccaacacaaaaaagagtgggtgcagtggaatgaggctgggtgaagagaagttcctcttcttagtgagaaaatagatcacagggcatcaagtaacatgtaaaagtctctataataaggcatttttttgaaaacgttttctaatattttggtatcaagaaaaccctcagatgaatttcaaacaccataaaaatacaatacataaacagaaaatattaactgtcaacaatgatatcgataaattgtaacctttatggatggctttttggaatgtaaaatggtacagcccactgtggaaaatggtttggcagttccttaaaatattaagcacagaattatatgatccaacaacaccctttaagcgctatatccaaaagaactaagatcagggactcaaacaggtatttgtacacccgtttaacagtagcattattcacagtggccaaaaggtagaaccagccctatgcccatcggtaggtgaatgggtaaagaaaatgtaatacacacatacacagaatactatacagcgataaaaaaaaatctcgccaggttcagcagcttacacctgtaattccagcactttgggaggtcaaggcgggcaggtcgcttaagcacagaattttgagaccaggctgggcaacatggcaagacctcgcttctacaaataaaaattttttaaaaaaaggaaattctgacagtgttatcaatgagccttgatagcattatgctaagtgaaataaaccagacagaaaaggacaaatattgtacaagtccacttatataaggtatctagaataaacaaattcatagaaaatagaatagtaattgccaggggccaggaggacggttcaatggggagctattgtttatggagtacagagctgcagtttacaatgatgacaaagctctggagatggagagtggtgatagctaacaatgcggatgtgcttaacaccagggacctctgtgcacttaaaaatggttaaaagtgttattttatattatgtatatttttaccaaaataaaaaaataaaaaataaaacaagacaccacataaggacatactaagatggcaaaatctaaagcaactttttaaaacccagagagtttttctgtaaatagcatatgaattaaatgcctattaaaaattagcccctttaatttagttgaattaattctacttttagagagagcttaaataattaaataaacttaattggaagcataactgaaaaattaaacactagatgcaggaagaggaactgtaaaaacatatctatgtacataaaccaatttactgacaacactcgagtatcccttaactaaagccccagtattccagagaagatggacaagcacttgaagagctgtcagcaggaaactgttgtacctaaaaatgtcagtaaatcttcattaaagagaatgttctattttcctattattaaaggttgtcacctagctttaccatctgttaccatgtgcattgactactaggccagatttagacatcaagtaatgaagcatacatacttaggaagttacaacttataataacaaccacgatcagaaaaacagtactttgcatcatgaagaccttcagttaccacttagtcttcatcctcatgggctttattgatcaatattgtaaagaggtatattacctcttataacttaaaacaacttgtcgcctaggaaagcataccaaaagaatcatcttttatttccaagtgaggtgttttaagaataatataatctataaaatagaataaacatacaacagaccaggcatggtggctcacccctgtaatcccagcactttcggaggccaaggtgagtgaaatcacaaggtcaggagatcaagaccatcctgaccaacatggcaaaaccctgtctctactaaaaatacaaaaattagctaggtgtggtggctcttgcctgtaatcccagctactcgggaggctgaggcagaagaattgcttgaaccagggagtcagaggttgcagtgagctgaaatcacaccactgcactacagcctggcgacagagcaagactccatctcaaggaaaagaaaatatatatacaacaaatacagtaacacacaaaatctctttttctcctaaccttctgctggtccttcaatttctgctggtactgttccgtcactgccttctacagaatgatggcttcctaaaaagaaaataaacatgtaataaaccaataaaaactcacactgaaaaaagagaatctagataacaatgcaatcacttttaagatataataaacataaaaaaagattcttttaactcaatggaaacaatactttctaattcagaaaaaaaataacacttctattaggcagctaaaaattattattttaaaatacaaatacagagtagaccaaagtaggtttgtggatttaatattagttactgtaactgtatggcaaaattactggatattggaacctgaagaagcacaattatgtttcaagtaccatgttcatctgtcactgacacacacacagacacaccattgtgaatgcttgctttgctcagacacttaattaactctctataaataagtttagggtttgctgtggaatgctccctgctttccattttcactatggtaaaagctacagaaactcgattcccataatttaatcaaagttgtacttaaagtaactcgtaagtaaaaattaaagatactacctttagtatcaaaaaacattttaatccaggtaatataatctgcttgcttctaaaaactgggacataaagcaacagatctgttaggcagtcacatggtaaacaggcttatcctactggagcagaagtttattcacaaataggaaagaaagaatctaagatatcggagctccagtaaggattaagaccacaagctgcccccaatatacatcttctgtccttgaagatctgagctactaacatggaaaagactgaaaaacactgccttcaagtataaataaaaaagtattgcattttggtaagaatacatcgcttagggggaagggaagcagatgctcatctattttgtcctgtctattgataaattcagaagctgtactaaaagttaaataaaagttataaataaactttctcttaatttttaaagagtaatgattaccgtctgaaaaattcatttgttggctactattcttgaattaaaagtgccatactgaggtgaaatctttttggtttccagtatctagctttattatgtaataattatcttgggattcttttcaacttactgcatattgtgaaaactcacctgaactcaaaactctaggtaaatctataaacctctatgaatccatctttaattcacttgtaaaacatactttctctgcaaacatttcctttcttttcttaaccttaatatttggattcagggagcattaagttctttgactgcaaagtcaaagaaaaaagagatgtgaggtcaaaggaatgatagataataaagaagaggccagtaattaaaacgtaaaatttcagtaaagagtaacagttaagatggttgttcatgttattacccaaacaccaagggtttggtccaggtcctgctgctcaccagacagaaactagtcactgaggcgacaagtattaccaaggaagaaagctttaacctggtgctgcagcccaggagatggggtctcagtctcaaatttatctccttgactcacttaaactagggtcaggaaagaaatacaataatgtataagagaacagaaattaggggctggcaggaggcatctagtgcggtgatctggtatgtttcagttatttgatacttcctgaaggtctttttttgaggagacaactcagataaaacagatacaagtttcaaggtttaacagcagggtcaactcttatgttgatccaaacaaaaccccatccatgggacaattgggctggtgtcaatgtaagcaataattctataggtcctttttgttcaaaatctgaacaattaaatttatattatatgctaaaccaaaggaaaatacatcttatgtactcgaggccagaagagataggagtaaaacctactactaaatagcctatgagtgtcaagtttgggaacactacaaaaaattacaaaaaagtaataaatgcataaaagttacagattaacaagtgctatttcagaattcttctaaatactaagtacatgaccttattaatatttgcattactaaccacacaataagaacctgacttatgactattctgagataaggtataaatgtgtacctttaccttaaatgggaaagtgtgtcatatacccacatcgagattcacaaaagggaaaactgatttgaaaaattgttgcttgtgaagttcatttatacgttaagaaaaggccaatacaatttttccttttcaatatagaaaagtaattcttaatactatagttataaatactaaaacacagtctgtggaatacaagaaaccattaaatacaaacagtatgtaggaaagtggaggtaaaaagattacaccttgcaaagacttcaggacaagttttgcatgtcatcagtttcagaagggcctgctttgagatacaaagataatacttcaacagtaaccccccaggccagaggcagtgacttatgcctcagcactttgggaggccaagacaggcagatcagttgaggtctggagttcgagacagacctggccaacggggtgataccccatctctaccaaaaaatacaaaaattagctaaatgtagcgacatgcacctatctagtctcagctactcgggaggctgaagcaaaagaatcccttgaacctgaaaggcagaggttgcagtaacccaagattgcaccactgcaccccagcctgggagacagagagagaatctgttaaaaaaaaaaaaaaagtcatgttcacgtagagttaggctccacagttcactctcttaaccatcctgtattctacccactctatgctatgcccggtcactgatgcacctgtatggtagctcatggcccccttagagcttagaacctaggtttcatttcctgctctacagctatataatttaacaattttcctctcgagtttgttggattctaaccctatacataacaaatcttattaatattactgcatcttaaagggggctgtgatgtcttcagtccctagaaacattaaacaacctataaacaaaggaccatatgagggtaaacagaatccaaatttctatacgctttaaaacgctgaggcaatgtactgagaaacacacctaagaaactgcaaccaatctactgtcgacaaaaatttagacgctgtcgacaaaaatttagacactgtctcttcaaaataagctatctggtggtacttatccatattcccacatgtatcaacagtattttacatgtcataaacttaaaaataattttaaaagtgtcaaaattataggccttaatccatttctgtgggcttgaaaaatgataaaatatacatttgtttctttattcaataaaatgcataaacttctagtgcaatcactaaaaaaagagttcataccaaaggttgtaatactaggaaagagggctcaatactgcaggttcttaaagacaaaagttaataaagccttgtttttggttgtgaatcttggccttaaaacattatttgcatgatccccgcttccttttcctgttgtaaagatgtggtgacaaaccaggtttggtcacgcagataataatcttgaaaatagtgggagggaaataacatgaagggaatatagtttacctaatgacctcctaaattggaacttattacccccatgcctcttgcatatctccagactaatatgtaagacagatgaaacagctgtttgctaccaatattttatttgatgcttcttttttttattccttgaataactgcttacaatgcgttaacaggaacaggaaagcatatctattcaagtactaaataattatgcaaatctctaagacatagtaatggaccaattatttttaaagtacaacacactgacaagtactttatttttaactcagtcttggtttgttgttaatgccattgcttgggaaaaagcaaacaaaagcaggaggtggtgaaggagaaacaagaaatagaggcagcagcataagcaaataaagaagaacaagaagatgatgatgagaataaaagactggaagaaaggaaaaacaacacgtgagggaatcggaaggcctattatgataccttttttcccctccttgattcatgaaatttgaaaaagttcaagactttttcacaacaacaacaacaacaacaacaataaagagcaaaaagatacacagtcacccctaaattttgttaagattgcgataatgctccactcacacctggctcaggtgccagcagaaggatgggaccctccagattctgcaggagaagggggaggactcctccttgccctggcggcacctccactgctgccaccgaggccgacggtacagcacccacagcttcctacccacgccaggccaggtggctccgcagtgctcctactcccacttcccaggacccccagacttgctgctgctgccaccactaaggccaatgccaatacaaccactgctgctgtcaccctcgatgcaccggcactccctacaaggcccctactagctggccacagccacagccctgccacaggtggccacagctggctgccctcctacctactgctccaaagtgccacccaccgcagtgacgccagccgccacgtcccaggctccaggctccagcctccaccctccagcgtgtggcaggttgctcctccttctggcacagagcagctgggccagtaaagtcagaaaagcctagaacatgatgcagggagtggtaacgttagagcctcaccttgtcatggtggccactgggtggcagtgacaggtttcagtgaactggagactccaaggtggctggctccccacccacaggaaccgttgggcccactggggctgcggctccttggagagcaggaacagcagaactcagacccagccactactaccccgcccaacccccggcccctcctgcgcccccaccccgagtgccggtttccattcctaacgtctccacccacagggccctgtccccccatgacgcctgtgccccatgtctaccccatgactgtgctcaggaatcccaggttgtctcaacacagagtaagaggacgcagacccaggaaccatgacaggccctgccatgcccatgattcccatggaaacactgtgtgcccgctgagcagtaggaggtctccttctagagtctggagcctggctccttccttggaggccaccgctgtggcggccacctctgccactaccagcagtgcagccccgattgcgcccctaacccgccgctgacagtgtagcccccgatagtgtcccaaacaccaccccccactcccagggagtgtaacccctgatagcgcccccaacccgtccccacctcgaacactgcagcacccaatagagaccccaacccgcccccacactgggagaaataacgcccgtaacagtgccccaagccccactccatccccgggcagtgcagccctggatagcaccccaacccgctcctggctgcaggcagtgatgcccggaatagcgcccccaagccgctccccaccgtgggcagtgcagttgagaatactcacctacctgggctgcctttctaccactccagcagccgtgcagtccctgtcacagccaccagcttcagtgaggcaagccagggtgccacaggctccggcctccagcttgtgtcaggagaaaccaccttcccctccccctgtagcaccgcacggagctgctgcagctgctcgtccgccatcttaccactccagctgcgcttcagtcgctgtcgtcgcagccaatgttctaattggatgagagaaaacctctaggcttattctgattggactttattatcatgttctgattggttagcctaaggcttactctcatccaatcagaacatgtaacccaggaacctcggtatataaagcatgctaagggggagtcaggccattccagactcttctgcttctgtctgctaagctggtgtgtgccaggcttagaaggggggaaggggctgggcatggtgactcacctgtaattctgaggcgggtggatcacgaggtcgagtttgagactagcctgggcaagatggtgaaacccccgtctctgctaaacatgcaaaaattagccaggcgtggtgctcctgtagttccagctacttgagaggctgaggcaggacaatcgcttaaacccaggaggcagaggttgcagtaagccaagatcgtgccactgcactctagcctaggtgacaaagcaagaatccatctaaaaaaaaaaaaaaaaaaaaaaggaagggggaaaggaagagccacctgctgcatgctggaggctgtagcctgcagctccacagctgggcttgctgcagtgagtggcagtgatgcagcatggcaggagcggtaggatctggatgatttccagcttcatccatgtccctgcaaaggacatgaactcattctttattatggctgaatagtagtccatggtgcatatgtgctacattttctttatccaccaagcaataagatttatcatctagggggccagttgcagtggctcaggcctgttaatcccagcactttgggaagccaaggcgggcagatcacgaggtcaggagtttgagaccagcctgaccaacgtgctgaaaccccgtctctactaaaaatacaaaaaaaaattagccaggagtgctggcgcacgcctgtaatcccagctactcaggaggctgaggcaggagaatcacttgaacccagtaggtggaggttgcagtgagcagagatcgagccactgcactccagcccgggcaacagagggagactccgtctcaaaaaaaaaaaaaaagatttatcatctggggtatcaggtgagaggactagctaggttgggtatatggaattagaactcatgagtgaagaaattcaaaattaaagttaagaatattactggtctatatagcatttacagaagagccaaatagacaatattccagactatagaggttagagaaaatcaagttatctatcttaagagcacacttttttttttttttttttgagacagagtctcgctctgtcatcaaggctggagtgcagtggcatgatctaggctcactgcaagctctgcctcccaggttcatgccattctcctgcctcagcctccctagtagctgggactacaggcgcccatcacctcgctcagctaatgttttgtatttttagtagagatggggtttcaccgtgttagccaggatggtctcgatctcctgacctcatgatccacccgtcttggccttccaaagtgctgggattctaggcatgagccacagcaccaagcccagcctgcttttctttaaattttcggataacacagaactcagcaacactttgacagtatggatgattacatactatttacaatattattgtcttcctctatctacttgtttatttactgagaaaaaggtgtcagcataatcacggaagcaacctaatgaataaactacaccttgattataagaaaattaaaattgattcatccttcttgaatacagagttttaaaaattcttaagagaattatggcttattgagtatgccgcaatccttttctgttacaaaaacaaagacaaatgactgctttggggttatttccccaaatagcttccatgtgtttctccatctggtacactgcaaaacttcttttaactcctaaggcctcaggagaatttcacagcccctttataaatcctggaagttcaggaaagtgccaacacgtgctgagcatgctaattcccagtgtccttggaaaggagtcttgatagtagtggactctcccttagggaagtctcacatggcaggaaaccaagcgactgtaacacagggtctagttgtacggtgatctgcctcactcactgttccttgggttcgttttcctcagctgggcacacacagaattatggctttgtttgaacagagttcttttggaccatatgtacctatgttagagccatttgactcccttcattattggtggtctccaagcataagaagaatattgtaggccaggcatggtggctcatgcctgcaaactcagcactttgggaggccaaagaggaaggatcacttgaggccacgagttcgaggccagcctggacaacatagggagaccccatctctacaaaaaatttaaaaaattaattgtacatggtggtgcatgcctgcagtccaagctacttgggagactgaggcaggaggatcacctgagcctgggaggttgaggctgcagtgagctatgatcacaccactgcactccagtctgggcaagagagtgagctcctgtctcaaaacaacaacaatagcctcaacaacaaaaagataaaaagaatattgtagataaatgggagaatgtgttcttagaactcacccactcgaaactcaaggacatcaaattgatagtcttggtgactttctaggtaaaaatcttcaaaatgaatataaatagatgaatttccctgatttggattgctgagagtccattcacagtttaggtttctcgagtaattcctgactccgtcatagccaggagaagtaaagtttccttcaggagtatttggaagagacccaccacatactaagaaaacagaaggcagcagaaagtagtagtaagattcaggccacaacagaagagataaacaatagaggaacagtaactaaaacatcaacattactgctttgatttgtttttctagatgcaatcaggattatgggtaaaaggcatgcaaattatggaagtttctgcacgtttatagaggaaacatgtgcaaaagtcgacaacttctctattttcctgttggtgtagattaggtggctggggtttggctctgtatcaatatgtccaaatattgaagcctactgctcattaatatttaatttaaaggaatacccaaatataatggtggcaggtcctaatggcttgatagcaattctccacttgatctaataatttaatttaaatcaaacagataataagacattgacctaccaatgaatttgcccccttttaataaaggaacagatgcttcttgtaccaatgaaataacttagtgtttttttttaatattcactcccacttctaaattttaaaacccttagataatagcaccaatccaggaaataggaggatatttacaattagaggccatatcttgcttaattttggaatattctatatcaaatcaaacctcccatttattttcgctggaaatatgtgtgtgaatagatgaccagaaacagtaaagcctgttctgtcccaagcaaaattaattactctccgagactaagttaccttctaggaggtagatggtttctttcagcaccaaataattgaccaaggactacggaacaggtcaccaatcctttgggtaacatgactgaaactgtgcaagaagctcatctaatggcattaaaagtttaccacagcagtttcttcctgaaatcagaaagcttttttctgtctgcagtaagtttttgatctgcttatatgtgtttgtcttatgtcaaatattccaagtgaactttgatcactaaagggaaaatggatggctctgctgacattggcagtagctggggggcatctgcagtgcacctgattaaaatgaagtacatttacaatatcctacattatctgcatcttcaccggaggtataagaagcagtgaagcctccatatggcctagatccatccgtgaaaaaaatgactttcattgtgtttcctgaagatttaatctcactgcttacattcacactactacacagtttctctagctggggtaagttacttctaatgctattgaatacctattggaaaaagagtttaacctttagacacacaatccatcttactgcatatttcctaggaggtgatattcctagcccagacccacttccttctatgggaaccctgccctaaaatgaatgacctaacaatgcaggtttctaacccagtgccacaagccactatgttaccctgaacacattttgtgacctcagggtgatttcactagaatgaaagtattgcagtaatgccttcctgccatgtggtgacagattaaaagctgctatacactttggaactggaaactgagctcccaatataaaggagataagccatcatgcttacaatatgttgtgcagagctcactggtgggcagtttttcttaacaatgcatcaggacttttgctatttgtaaaggaagcttaaaggttagtttctgatgatttgatatatataataaagcagatatttttattttaatatttatttatttatttatttattgagatgcggttttgctcttgttgccctggctggagtacaatggcatgatctcagctcagctcactgcaacttctgcctcccaggttcaagcgattctcctgcctcaccctcccaagtagctgggattacaggcatgcaccactgtgcccagctaattttgtatttttagtagagacggggtttcaccatgttggtcaggctggtctcgaactcctgacctcaggtgatccacctgcctcggcctcccaaagtgctgggattacaggtgtaagccaccatgcccagcaagcagatatttttaaataccttgaaaagtaatttgaaaaatcaatctccatatgcaattaaacataatagttctttcctcattagttatggattcaaagcttcaattttctcatttgaatttttaagaatggattattattgactccaaaatattaaataataactgtagtcattcacatagttacaataattggcaaattgttccaatgctgtacaaaataaaaaaaatttagatgaaataactaaacaataattcattgattgagtgattgatattccagtgtttaaaaggatttgaatgactcaagattagaaataatgactcagactatggcactaaaagttacgcagtaggagaatgcactccacaacaaaacatgtcagtttttaaaatttactataattaattaaatttagctctctggggacttctggtctaaagtgtcttccagctcacgcgaccagaagaagagtttgctatcatttaccgagcagacaaaaatgccagtcttgctcatcatctacttagtctgtcttatccaatcagcacaacaccctcccaagcagataacagtatccctgttttccagattaagataccagaattcagaatgatgatgtaatttgctgaagttcaaataattactaataatagaactgggattcagacaatccctctgattccaaaccatgaagcagtgtataaagaaatagatgaggacaaatatttctataatgctgaaaacaggaatgggcatcacattgccaaaatcaaaagggattagaaccaactgtaaggttaatgggacatgttggaaaccatgatcaatggctgttatcctgcctctgagtctgcctttggcgtagaatcacaatgactgaacatgttatagtcatccatttatcacatggacttctgctgttagaagcaaccagaatgcaattctcatcattgtgctctaatcccttttgtactcagaaactacaactctcagaatacaaatggatgggaagtaggcacgtgagatttaggacaggctataacatttgctatgaacagggacaaaatcagatacaggtcatattgtaggacacaccgggtggcatagcttttcattttctctgtctgtacagagagtcagataggcaagtgggtttggagaaattttaggctcagaccagctggataaggcattagccacgaagcagtgcaatgaaagttaaagctgcctctgcaccagcagatcttctttcttctttactctttttttttcttctccttcttcttttctctttctccctctccttctcaatctcctccttcttctctttctccttcttcttcttatccttttcctcttttctccttcttcttttttctccttcccttctccctctgtctctttctccctctccttctccctcttcttcttctcccccttcttcttctcccccttcttcttctcccccttcttcttctccctcttctcctcctccttctcatcctccttctccttcttctgcctctttcgtcttcttcctctttttggcaagttgtcaatcaagtagagtggcagcaaaggcagacccacatgcccttgtttggagcagagtaaagaggaaccaaaataaacattgaacatataaaaatatatttcagaaaaaggaatgtggacattatactaaagattcagaaaaaaaattaattccgaaagtgattccttgctggagttttaacctccccaagagaaaagtcctgtggatatgacatttgtagatttgtaggtttccttatttaaagagtcagggcaccctcatgcatacagagatgccagtcatccttttggcaattcattcttaaatatgaatgaacagccaaggatcagcagacatttagggaactgactaatgtaaaaggcagagaccaatatgagtaaacgggagataggaacatgaagaaaactgaccccaaataagcaacacaaaacttcaaaattactattaatatattcttgtatatattaatatagtaaacatgtaaaatatttaaatatatatttttcaaagaacgatggtaaaataaagataatttcaggtatatcatttctttaaaaatgtattgcccttgcccatttccttggggagctacaagagggtatgcctcaccaaaagaggaaattaaccaagaaagggacgtgcatagcatcacaaagccagctttctagcccaagagcagaatgaaagaacttgcaaatctgctggcaaagggaaattctgaaatgacagctagcatcaggcttgcagctgtggacaaaggctcaaggaaggatattactgaggaaaagaaatggaactgatatgttttactacagaaggtgaagatgaacacccagggtggaaagggtgtggaagaattagtgatcagtgcttaaaacccaagaaaatgtaaagaggacacaattattattattccttgggaaaacaaaaacaaatgttgccacagtacactacttggctcagttgtgaatggtgtttatgtaatcatggtaatgtcaactaaatgacaatttaagcaaaagctgtgacatatgtattttgggagacatttgggaaagtatataaactgtgcataccccatgtgcatttgtggtggcagagggctaattctcatcttccagagtaggatgtggatagataatgtccaaaaaaagcaaggagtagtagaataggaatattatatagaaataatgacataaaacccaccggcagtagctgcaagagttataagttgataattaagggatagggagatgacaactaagatctgctttggaatttgtggttgtggctataacttttatctttatttgagttctaaaactatgactgttcatattctgtttcctaaaggacatgtgaatactctgcttataaaattcctaataatcattatattcagtatgatttaaactatgaaaataatttcaaaggtaaaaaacaactgctcgcatatacatcaaaattttagtaatagatgagtagaattaaaaatatctttatattttttattttctgaactctccaaatattgctcaataagcatccattatatttattaccagaaaaatagactaaaattagaattcaagtggatttatatcatataattacagtacataaaatatgctttgccaagaagagatgagaaaatgcatcaaaatatgatatagtgggactggttagtattttttctacttcatctctgtttatatatattcaatcaataataggaaacaaagtttctttataataaacaaccttagtccaaaatttcctgtctctcaaataaaagaaaacacacttggtttcttattttcaagatctgaaagacaactgttcagtccttcagatattagaacttggaaataaaatctgaaggttgaaggagatcattttagggcgatacaaagtggtcataagatacaaatatatttcatatttttgaaattgactacccaacagaagacaattaaactgaaaacagaagtggcttcttattaaagggataatgatagtacctctaccatccattcattcaacaactatttatctctattatatacaggcattggggattcagtgagtctccagcagtgaatgaaactatggcttgacctcagggagcttacattctagtgggggaagcggacaataaactgatgaacaaatcaaaatgatgtgtggcagcaggtgtaaagtgctgtaaaacaacatggcagagaagtggcaggccagggtggggtctctaatataaggtacttacaccgtatggattaaaaggcattcaagcagagacctgaatgaagtgagggtgtggagcaggctgccatctgagaaggggcattccagatgaaggcaacagctggacagggagcatctcagcacattcaaggaacggaacggaggccaggtggctggaccccagcgagcagagaataggggagtttgagataaggcagataggtagaagagggaggggcagcagataatgttggccaggtgggccacaggtgcaatttgggattttcctctgagtgagatgagaagccattagaggattttcaaagggagcaacatgatctgattgaggcttaaaaccatcacatgctgctgtgttgagaatgtaaggagttgagaatggaggcagtgggaccaggtggaacttactaaaataatctaagtgaacggtgggggtggtagtagtagatataataagtagtttgattgtggattttttttattttattactattatactttaagttttagggtacatgtgcactatgtgcaggtttgttacatatgtatacatgtgccatgttggtgtactgcacccattaactcgtcatttagcattaggtatatctcctaatgctatccctccctcctccctccaccccacaacagtccccgaagtgtgatgttccccttcctgtgtccaagagttctcattgttcaattcccacctatgagtgagaacatgcggtgtttggttttttgtccttgcaatagtttgctgagaatgatggtttccagtttcatccatgtccctacaaaggacatgaactcttctttttgtggatatttttaaagagacacccaacaggacttgcttatagatgccatatagggtgtgagaggaagtattccaaaacagacatcaagatttttgaccttagccaccagaagtttggaattatttactgagatagcatatactgcagaaggggcaagttgggtggagaaatgtactaatattaatccaatctacctatctacacacacatatgtatgtgtagcacttcacagttaacaatctatttgttattcacactcagggatctcatttgctttctttcactgcaggaagctgagagtgctgagggcacatctgaaaccactggaggttggcgacgtggaggtcaggtagtagtgctctcccaccaggagtccctctgcacccctggagagagcagtcattatgcaggacaacccatctgctcagaactttcagtggcgacttgtggtgtgactctgttcccattcatctatgtgctgctgtaggcttagcttcccacagcctccccagctttgccatttgtcattatcatttactcttaatatttattctatctatgaccctgatgcacagagtgatagctgatagtctcttaaaacaacgtttacaattattttgacagtttaccgtgttttgttctctcaacaatacttagaatttgtctgagttatagttgcatagacggcaattttcctgacctagttttctgactatgatttatgggtcagtaaactccttaaatgatggaatataacatctcaggccacagggaacacttactatcacatgctcactgttgcaggacggatgcgtggccagcctcaggttgctaaatgttagggtgatctgccttccttctggggcggtgattctccacttgtagatccggccatgaggatttaggttcgggtagttgggagaagtagatgttccagcagagccctgaagatccccaccacactctgatgtgggggaagaaagccaagaaaacttccaatcaaatcaaaatgtctccttccatcaggaaagctctcaaaattcaggtatttaaaaattatccttctagacaaaattattcaccgtatttatgtgcgtgaggatttcagtgaacatatacattgatttcctatctctattaatatttaaccctggcttccatggatgatagtccacagacagcaatttaattatcatcatggcccaagaaatatgagagatcaatgaatataatgaacttaagaatcacgaaaatcaggtcgggtgtggtggttcacgcctgtaatcccagcactttgggagcccaaggcgggcagatcacaaggtcaggagttcaagaccagcctgaccaacatggtaaaaccctgactctactaaaaatacaaaaattagccgggcgtggtgttgggcacctgtaataccagctactcaggaagctgaggcaggagaattgcttgaacccaggaggcagaggttgcagtgagccaacatcgctccattgcactccagcctgggtgacagagtgagattccatctcaaaaaaagaaagaatcagggaaatcagccaggagtggtggctcacgcctgtaaccccaacactttgggaggccaaggcaagaccccatctttacaaaaaaaaaaaaatcaggaaaatcagaaggttaatgtaggtatccagtttttccaaacaagatctttatttcatctgagtttgttggatttgcagtgaggcaaattctgagtaactacaggactttcttaaggcaggcattgcagtataactctcatcctcttattgtatctctcgtgatactagttattttcccttatagcactgatcacagctgtaactttttgtttatcagtgtgactttttgattaaggtccaagaagataggggtcatgttttgttttgtttttcaaactattgtaacaccagtgcctagcatagtgtctgtccaatgcaggtgctcaatgttgttttgaatgaatcaatgaaatcaccgtctatgctggattcaaatcgcagtctgaatcctgaggcagtcagagagccatctatgacaaacctgaccatggcagtattgctagaagtctctatgctgtcaggaatggtgtttgcacagtatcttcccaagatgtttcctgtgagagacaaataattaaatatatatgtccaggtgattgatttcttttaacctctattcaaggtgtcctgcgtgtacaaagaaaataataaaaaacaagaccttgcccatgaagaaatattaatctctctcaagaaaacaggaaaacatgaatgaaaattaacatattcaaatatatgaagaagtgaaaaaaatgcaaccagttaggggaaggatatctcaggataatgaggaaggccagttttttggttgaaaaagtggtttgagacaacagagtgacaaatatctgccttatgctactgccaggagacatgcatgaccctctttctgcctcaagctatagaacacccctcaaataacggcatctggcaatgggatgtctcagcagcaacaggttgccttcccactaccgttgctctccccaggtggcctccagggtaggctatatgacacctgggctctggacatccattgttaatggtagaattgaggtagagaatcactggtactgcccaaagcccattaatctgcacttctttgcagagtatagacatgctttgcctttcttggaagtgaagaaacttcagaggctgaataagtacatgcgaaaataaacaccccaaagagagcagatatatttcactaaccagaagtatgatagtcccaggtctccacaaagtctttttcacagccagaggaattctgaaggttaaaatcttcaaaagagatggtgagatagtgtctggagagcccctggagatgccaatcacagaataagttgtctctatatggaagcattagatggccaatgctttcaacaacaccactttgccctgttactcttcccccacactgagctgaaaaaaaaaagaaagaaagaaagaaaagaaagaaaggattctattacaaactgtgtttttttcatttcaccagcacatgtgaaaacttttaggtgccaagtgactatgaattgaagtttttaaaattctgaaaatgcttagtgctttcctcattatttgaattctagggttgatgtaaacagaagtgataccacaagtccaatccaataatgggaaacaagatgacgaccaaatggcacattctgtaatgtcacattaattcttttgggacactatgtaagagctatcagttgcaagcaagtttcatctcaagaacaaactggtagactcatctgacctgcctagaaccttgtgttgattctaaagactgaacccaagctcacctggaaggggggacacctgctatatctagttttactatcaactaaactttcactactgtaactgatatctcagggccttgaaaattactattcaattatgtcttattagctggatgtggtagctaattgaattatatgcagcttgacccgggatataatatgatctatggtgtagttaaatactgttacaactagcctttctgaacttttgctatattaaatatttgtttggtttgtgtctagacctatcagatactaaattgtgtgctattgtgaccatactatagtgaatcttcaacaagcaaagttactgctcaatttttaagtaaggaaatcaaaatcctgaagagacatatttgctttttatccagtgactgatttggcactagagactcagagaaaaaaaaaaagcttaatcattttatatatgatgaggaattcaaagacattgttctaaatatagttatctggttcttaaatagttgtattacttaaagtaataaacatactgtagttcttccttttccttggcggatacattccaagtccccccagtgagtgcctaaaaccttggatagtaccaaaccctatatagacatatagacaatttttttctacatatatgtacctatgataaagcttgctttatcaattaaacgtagtaagagattaactaataataaaatagaacaatcataacaatatactgtaagaaaagttatgtaaatgtggtctctcaaaatatcttggtgtactgtactcacctattttttgggcctctgtttaccaagtgcattgaaaccatggaacatgaaaccatggataagagagaactactgaatttcatagtaagcagaagaaacaggagtttgatttaactacacatatttcttcacaaataagttagaaaaaatataaaatattcaagtttactaagattacattttaaaataaaaattaaaagagaaattaaagttgatgactgtggttttaaacatttacactccttacttatttatagcattaaaatatttttaaaattatgcagatagaatgacttctttttaaaaagtcatggttttaaaaaaagttttaacatattcatcctgtaataactcttttatttaatataaaaatgttttccagggtttttatagttttgtgttttacagttaagtcttcaatctatcttgaattgatttttgtatatggtataaggaaggggtccagtttcaatcttccgcatattgctagccagttctcccagcatcatttattggatagggagtcttttccccattgcttgcttttgtcagctttgttgaagatcagatgcctgtaagtgtgaggccctatttctaagctctctattccattttattggtctatgtgtctatttttgtaccagtaccatgctgttttggttactgtacccctgtagtatagtttcaagtcaggtattgtgatgcctccagctttgttcttttagtttaggattgccttggttatttgggttctttctggggtccatatgagttttaaaatagttttttctagtactgtgaagaatgtcatggtagtttgataggaatagcattgaatatgtaaatttggggaagcagtatgaccactttaataatactgattcttcctatctatgagcatggaattttttttcatttgatagggtggagggtgggagaagggagaggggcagaaaaaatagctattagatactaggcttagtacctgagtgatgaaataatctttataatgacccccatggcacgagtttacctatataacaaacctgcacatgtaaccctgaacctaaaataaaagttaaaaaatatatattacctatagaatacttggccttgaatcccacatgagtggggctgttgtcagaatgaaatctcaaatacataacctctcctgacgaccactgactgctgggcaaagatgtcccacaaaatttggaaagtattggtgcatctgaatccactccatcccacaactaggggtagttagaaggacagctaaagtggaaacaaaattatgttaaatttacatggtcaattgccttgacttattttgataatgacaacttcacttactttctttgaagatattattaaatcatcatttcttagcataaaagactatgatagaatcagcgtaagccatgtgtcacattaaaatgctgtatgatatttttcctaataatacattctttcattagcagctcagaaagacaggttttacatgttctacattgaagaatatttacttcccttccatattctgtattggttttacaaatataaatgttgttttcaaattaatccctatgaatttcaaaaaaaaacaagtattttgttccacacaatgatttggtacatttcacatgataaagataaattctctaacagctctgtaattgggactaacagagagtcccaactggaattttctgtgtccataagagtagacaagcatgtatctagcgtttcttgaggaacttacatcagctaattaatgctccatgagtggaagagtagtattaaatccagtgtcagaaatagcaacaaaagctcttatatcttagttttgcaccacagctgcattcatgcaaatgtatacacacttttgttaaaggaaagaggaaaacggttttttacaatctatatatttttactttctcttcaacatagtaagacttactctctgttttgtaatactttcagaactcttattaaataaagactgagaaattatactgtacgtgctttagtactgttctgacactagtgacccctggtgacacaccacacaaattcccatttgttaaacagacattttatcatttgtgacactgaataagaggctgggcaaataaatattcatctctcagaaacatgacatatttcctgcgggaggaagaatggataaacatcaatctcaagtagccatcctcaacgtcccttgcaggaagtgtctagggtcacaagggacagtatccatgtacataacctactcagctgatgggagagttgctggcagactgtgttttcatgcctgagttattaagcatttccctttttccctagatttgcttgcagtatgtgctactgaaagaaatgaattgttctgagacatgacagttaaaaaatactaacttcgggtaggaaaaaagtgaaaatggaagtgacatacttgggtgttatttcaatatcaaattgatcttcaaattgcagccgtatgcatgtttccggtggagccgctaagatccaaatgcaatcagcgtgcaggggataattatcagggtgggtgggggaggtcacatacccagcagaatcagctttatggatgtagatgttgcccccacaggctgtcagcaaacacagttaaatcaatctacgctctggtgaaggagatgcattcaatggacaaaaatcatcttttaaagtcaacttctctgtaatttgtctcaatttcctttcatctgttatgatcctcattttcttttccagcaaacgaattctcaatttgctatcgaggcagctaccaggtgtgacactttttaatttgccagatcatctatctattctcattggaaatttcattctttcttaaagccaaccaaatgattatggcacattgtgcatggggcagaacatcacagaagcacgaataaatatccagcacttcgataagcatgtaagtatgctagcagttacagcttcccactgagcgttcagtacagcagaatgatgcagagctatgatcttggtatacttaaaagactaagcagatgtatctttgcacaactctgggggcattcattcatcacatttcttcaggatttagatgcatttgagaaacaaggtcaatggcatgagacaatttataagccatgttttgctagatgataacggagctttttaatacttcttttctaaaaaaaaaaaaaagtattatggaaaaatacttttctattgtcaataaatattctttggcattttcaacaaacaaaccagacaggaataaatgtacttacaatgccaatgccaatgaaattaacctgtccaatcacttagccacacagatacttgatctgctcaactctagcaacatttatgtccactgtcactcatccacttacagtcacatcctgaattctgtcaatacctccaactcccccatttctgaaactgtaaattgcaaatctctttgatgacgtccaactcccttgcttcatgtctttccttcaatgtcgaaagacgttcacaaagggacctatgttaaaggctgagaaataggagtagcatggaagtagatatggtgggaagatagccagatagatatgggaagtagaagcctggctatagttatggaacatggttgagttggtaagtagagagaaataagagtgatgctattgtttcaggttgccaaaaataggttgtgaaatcaaaagacttttgtttaagtctgatgttaatggcagtaataacaagcttcatgaaagacagggagaaagcaatggccatagccatacttgcatgaacagtgagtccacaaagaaatagaagaggtgcagtgtcaaatatacccttagtgtatctcttagtgtatctgaattaccattaaatgttgactttaaaaacttaaatcaagactgagtctattggctgggcacagtggctcactccagtaatcccagcactttgggaggctaaagcaggtggctcacctgagctcaggagttcaaaactagcctgggcaacatggtgaaatcccatctctaccaaaaatacaaaaattaggtgggcgtgatgatacatacctgtaatcccagcttctagggaggttgagtaaggagaatcacttgaacctgggcggtggagattgccttaaactgagatcacaccactgcactccagcctgggtgacagagcaagaccctgtctcaagaaagaaaaaaagactgagtcgatcttaaataaaaatagaaaagtagaattctgtcatgtgggctgacatctactcactagactcaagacactgctactctcaaaatgctttggtaccaggtgaaaacccgcccattcctgactcagttgcaaagctcaacatggagagagggaggggtgagaaggtcccagcctagaaagccatagtgcaggtgcccacagagctgcattaaagctccctccttgtgccagagctctgtgcactgggaagtgaccaaagccccttccctggtgttttggaccttactccagctattcgattatttttgtgtgtcggttggtaaacactcttactcatttcttttaccaaaatgaagaaatgatgttgactttaaatctcatacaatgtgcaataaaacatatgatttcattgatatttatttatatataaatacatttaggaatctgggatacaagtcataggatcattttgaaatctatattatctaacttctggtgtgacaaagcaaaaatttattattatattactttctactgacattactccgttttttggaagtgatgcctatttatttatttaatttatttattcaattaaacattactgaaaagtaaatgtcaccaaaatcaaatcattacagtagaattaaatgcaattataatcaagtgcaattaagtacaaggaattaaggaaagatcttaggtaatatataattaaatcagtaataatagaatcaaaagattatatgttcttttaaaaacagcatacacattattacaaaataaggcaaatgtaattcttataatgtttctataactagatttaacttacaattagacatcttataatggaaaggtctaaggagtttcagggatcaagaagaatagtgtatcttatactcatggaaaatttcactttggtcactaattagatatgtggccttggaaaagtccaagcctcgttttacttatctttaaaaccgaaataatggtactttacttgaaaagtagtcacaatgagatattgaatgtatcaaacataataagtacttgagagtaggcattcttattaattctattactgttagttcagaaaagaaaactttatatgtttttttctcaaatctacttaatcaaagaagaccaagcaattgcaggaaaagtagatataattctcagtgaaaatacttaccttaactctttgcctcatatttgatcttaaatccttgcccttcattactataatcagaaataaactgaacaaacatttgattatccgaggtgaacacagtcgatgaagcacgactgccacaaaaatgaacatttcctccacagggtccgaagggtggagaatagatatcagggccatttcctagctggaaagacaaattaaaattgcatcaactcctttacattgcaaaagaaggagtacgtaattcttatccatttatgtcccaggaaagaaaaattatcattttgttttctgaatgaagtctgtggaaaacataattagaaagggtagcaagcaagacctaccaccaagtaatccccctggttgcaagaagaatcaccatttggaatctggaaaggctgttcaaaatggacagcaatggtcaggccactttggaccaggacgtgccaggaacagttgaggttggatgggtaggtctctggatacctggggaacatgatgatcccttgtctgcatgcaaatatccaccagagcctccccacaaagaaacaaaggtaggttatttcaatagaattggcaactggatttttatgctttcttagttttcttggggggttttcacagtgtaggcaataaaaatgcttgaaaataaagccagagtgtaggaaatgattagcataacaagcatgtattgagcacatgctattggctactccgtttgtggtggttgttgagatatgggatatagaggtaagtaatgaagacaaattacctactttcataaagatttctttatagatggggaagacataaaataaacaatacataatatgtgagatagtgataaattctataaagaaaaatggatgggaggagggagaagggtactttattgtcagagttaagttggaaaagccacgtcattggagtaacatcttagcagagacattaatgaaataaagaatcaagccagatgtttatgtgggagaaagcattccagttcagaaaacagttaatgtaaaggcttgatgtggcagaggtacatcatggaagtcagaatggatgaggcagaatgagagattccaaaggtagcagcatgtctaggtcatgcaggaaactgaaaagacttattctgaataagaagaggaagacgaagggttttgggcatcagaatggcatgatctcacttacatttgaaaatatcactctatgtgcagtccttagactgtaaggagtggagggcagggaagggcaggagcagagtgtccaataaaaaggggactgcctgaggccaaggagagatgataggtgcatgggctaggctggtagcaacagaaatggagaggcgtggttgaaatctagatacattgtgagggtagagccagtgtgatttgttgatggttaagtgtgagacaaacagaaaagtcaaaaataacatcaagatttttgacttaaataatgagaaaaatgtactttccatttgctaacattgtgaggagtgtagaattgggggcggtggtggcatggaaaagggtgggaataaagtgttcagttttcaaaggttacattttttgttattggttatctatctatctaattgtggtacaagtggtttttggttaaatggatgaattgcatactggtgaagtctgagattttagtgcacttgttacctggctagtatacattacacccaatatgtagttttttatccctcataccccacccatcctccctgcttatgagtctccaaagtccattatatcacaggttaaatttgaaatatattctagaccatgagctgccaagtatatatatatgcacacacacacatatatatacacaaacacacttatagatacacatatttatatatattatatacatatatacgcacacatatatacacacacacatataaatcaattacaatggttctaccctcactatatacattcatatgtatacatgtatgtatgtataatgagctgccatacatattaatgtatacatgacagtgagagggcaggaggtgaaggaagagaatgaaaggagcaggcattaattctccagtggtcagggactagaagctcatcagcaaggaagggtagacagctcacacagctagttaaattgcagaggtgaaaatttatcccttgtaagttggattcctaggtattttattctctttgaagcaattgtgaacgggagttcactcatgatttggctctctgtctgttattggtgtataagaatgcttgtgatttttgcacattgattttgtatcctgagactttgctgaagttgcttatcaggttaaggagattttgggctgagatgatggggttttctaaatatacaatcatgtcatctgcaaacagggacaatttgatttcctcttttcctaattgaataccctttatttctttctcctgcctgattgccctggccagaacttccaacactatgttgaataggagtggtgagagagggcatccctgtcttgtgcaagttttcaaagggaatgcttccagtttttgcccattcagtacgatattggctgtgggtttgtcataaatagcaaacaccgcatgtcctcactcataggtgggaattgaacaatgagaacacttggacacaggaaggggaacatcacacaccggggcctgtcgtggggtggggtggggggagggaggatggatagcattaggagatatacctaatgtaaatgatgagttaatgggtgcagcacaccaacatggcacatgtatacatgtgtaacaaacctgcacattgtgcacatgtaccctagaacttaaagtataattaaaaaagaaaatttatcttaggtctaattccaaagcccatgctcttaagccactatgcagcctgcctctcttgagtgtgaggaacacaatttatcgtcagttgctccctactttataaaaggtatatataagcatggaggaaatattagattaatttttaatgttagattgagaatctactttaaaattatgtttttcagttaaaaacatgggagtctttcactcttccatggactactttattacctttcatttagtttggatttaaggctgttaatggacttcacatgtcaagtttgaaaagtctcaatcatactgtgcatgatggcatcccatatatggtgcctgtttttgactcatcaagttcatatttcaagagcaacaaacccttcctgccaaccctcaaatggatgactttaaccaagtaattcataaggataaatgatgacgttttgctccgtcgatgagttacggatatgagctgtgctctagttccagccctcagctaggctgaaaaattgctttaaagctctctctcatgcatttcatggagacacctcctctggagtgaagatgccccacccagaggcctgaagcaggacacttttgtacgacttggccacagtgctttggatcaggaatcagcattgacataaggggagccagccatccagaacctgggcagagacccatgtcctctgacgtggcttgtgtcctcgtgcccagaaagctatattaggaagagagaaagagagaggaaagcagaggagatgggataacatgggattaaaaaaatatttaaactcattactcttgtgaaaggatgcactgaagcctgccctggttacactggagtccaaggtgaagcggatgaccgtgtactctcagtagaccggatgggcccagggatctctctgccacagagaactgctagcttctgggccaagtcattttctcctacattgaaagaaaggaaacagcatgaaaatacagtcttgagaatctgctctatcatcatttgcaacttagccgaagcatctcacacatttttttcagaacatcaggattcacaggagataatgggattctcaaaaagaaggacccctcaggggtgatatcattctggctccagcttgcaatggtgctgcctgcccttttctttatcaccctgccttttttttttattttatgagatggagtctccctctgttacccagcttgcccaggctggtctcgaactccagagcacccacctcagactcccaaagtgctgggattccagacatgagccactgtgcctgctctcagacctcagtattttttaaggagcacatctgagttcttccacactggccactgacatattacacacagttaaaatctgggttttaacattcaatgcattgaatagcactgaatctgtaaatttgggggagaagtatggccattttagtaatattgattcttcatatctatgagcatggaatgttcttttcatttgatagggtagagggtggcagaagggagaggagcagaaatcactggccactgggcatgtgttgctctttttggctttagtgagtgagctcctgagattgtcccatgggaggatctgttgactcagagacccagaaccagggcaacccaaggccagcaggtgaagtcgaagaagtgtccgcccgatagcatcttatctatcctcagcttgtagactgtggctacccccctgcccccattctctttgtcgtcagcccctccaaccaaaatgtacctgttccagaatcctttttcttgaggtcctgttctgtgctaagcggaagctagctaacatgctaattcctccacagtatatttttaaatggaaccaccccaatcatgagaacttcagaacggtggcaggctgtggagaaaataagacgggggagtgtaagtctgtcactttccaactcataattagcccatgtgtgcggctgatcctgaaaaaggtttcttttgctattgatgatagaatgtctatcaaacagaattgatgtaatagcaaaatattatacatagattttcagttgatgcactctttcctaaataacttggtgtgtgtgtacatgtgagtatatgtgcaggatgttagaggagatacactaagaagtgcgatacttaggtgcatacattcttctagagcatctgttctcttttttatgtttctattttttagagatagtgtctttatcacccaggctggagtacagtggcatgatcctagcccactgtaacctgaaactcctgggctcaaacaagcctcccaaatggatgtgcaccaccacgcctggctaatttgcccaggctggacttgatctcctcggctcaagagatcctccttccttggcctcccaaagtactggaattacaggccactgtgagccactgtgcctggccttcttaacttttcttaagtcactgactgttttaaatagtagagtgaaaactacaaccctgatccgtagagaagtgcatgtgatggttctaatttcagcaggcctatggatcccattgtgttcatccatgaattctttagaggtccacatagctcagatttagaaactccagagttgggtgaagataacactagtatgtttgcatgtatgtggacatagtgatgctattttttttctttttgagatagggtcttactctgtcatccaggttggaatgcagtggcatgatttcggctcactgcaacctccctctcccaggttcaagcgattcttctgcctcagcctccctagtagctgggactacaggcgtgcatcaccatgcccagctagtttttgtttttagtagagatggctttcaccatattggccaggctggtcttgaactcccggcctcaagctatctatctgccttggcctagtgatgctatttcttaaaggagatgcttcttggaaatttgtataaaactttagacgatttttaatgcatcacagaactcattcttgatggcttcttaaaaaatgttgataagtgccaccttatttatctgcttaaatttacatttggttaaataagaatttgtaatcccatagctcccaggcttgaatggaacatgagtgtgggcacatgcagattttttttaatggaatacctttcccatttccatttttcattttcttcgtcagtcagcctcataggccaaaaccactcaaatacaactgataaccagttaacaaactcattgaccttgcattttgctgttttcagtctgaaccctcttttgtctaattttttgctatttctttagctttttttcccctgcctacatattctttgttctagttacctgaatttttctaaaatctgaagttcctacccctctctctggattttgcttatccttcagaaagttgagatgaatgctcatctttctctgtgaagccctccttttcatccaactgaaccagcaatttgtggaaagaaatacaagacaccccacagcctgcaggaccatcaagaacaacacctatgtaataacttcagcaggagatgaaagtgacaagagcaaacttgttgaacccccactctatatcacgtggaggagacaggtgtagttaagtgacgagaatgagggaacgacagagctttctgcacggcttccaagtggctgctccaccatgtaccctgctgtctctgcaagtgatgtgtgtgtgcacttgagatgccccatcaggtcaatctaggagcgccatgggcgaagtgttcctgtggctctggatccttactcgttccaacggaagaacagggacaattcctaaagttaaaagccatagttgtgttagttcaaagggaaagatcaaagctcccatgtggatttggtggattttcctagccttgggcctcttcctttccctccccttcctgccttcctcatgcagtgaccctaaagataaggtccagtaggaagagaagcagtccagttttggcctcttgctggattaattccttttttttttttttttttttttgagacagggtcttactttgtttcccaggctggagtgcagtggtgcaatctcggctcactgcagccttaacctccaggttcaagtgatctttccaccttaggctcctgagtaggtgggactacaggcattcaccaccatgccagctaattttttgtagaggtagagttttgtcctgtcacccaggctggtctgaaactcctgggctcaagcaacccacccacctcagcttcccaaagtgctgggattacaagtgtgagccactgcacccagcctagattaattcttaattgtaaaagaagacagaaactaatggcaaaacatgctttttatgtgtacgtgtaagagagtgcaagatagaatatgacttgcttactgtctacctcataatgttaataatcgaggtttacatgtagatatacattcaaatatattatacataataaagacatgtactcatataaaagagcctagatcactccttttataacactgagcttgttattctccattgatgggttgaagttttttttcatattctccttctctctcttcccagtgttttggaatttcctgggcatttttcctacccttccttttcttacccttcgctggatgtcacctcctcccccggccactgaatgccattgaatgccattgaatgccatttcctttcctctcagcgctgcttctccctcccagctccccagttaaagccctttattgatgtatggctttgctggaggggtagcacatcagaactggagtgcaatttagaagcggtgttcctgcaagaattcagaattcatatgtcctcctgaagatgctttggaagttaacacaagattcagaaattaactaatttttatatcctcagaggagaagaaatctatgcttatcagttttttaggagatttgtttggttatgcatacacctttttatagctcaggaacatatatttttgcatgtttggctttatactctcaaatctaccctattacttgcttataccttttttcctgtaattttcatgcaattcgttttcacattgctgctgaaagagtaggaccattgtgttgcagtgagttaagcaagggacatttttgtttactaaaatgacttaggctatagaatcctgaggcggctcataataggatagagtgagcatgtgctttcgggacacaggttctcagtaaatacttgttgtttattaactgaaagtagcattacctttgttatttataaaactaataatatttggagaactttgttatttataaagctaataatatttgttggcctttcttggggtagatccttagatattttgctattttatgtttaccttgaggaacatgtagaaccttttaaatgataatttgtttcactgtttcataaactttatgtttttaagtaacccagaactactgtaattcactgctttaatacctgctttgggtgaaatcccataaaatctgtgaagccagttttcattagtatacttttgaacttcaaactcttatggtaatatgtaataagttaattatccaccttgtgtttttggccagaaaacctttgttttctggccaaaactataactacaaatgacctttttttttttgcatataaagtgcttaggaggacttgaaagtaattaatcactataactacaaatgaccttttttgcatataaagtgctaaatagtttaattattcctatgcgagactgagaagattcttctttatgtataatcattaaaatggcatcgagaactatgatttgctgaaagaattggcacgtctataattagtctagacaccacctttgtgctgtgaatggactaatgttctccagttattatggctagagattaaaaagcctgtgctttcactttgaccacggatgccccaagtcatatttcatctcgtttctgctaatttggtttttttctcccttgcttcattcaggccaaagaggggcacttgtttttcagtatcatattcatcaaatgctggggcaaggaaatgtttactttcaccattttctcataaatggtccttccctctcccatacctataatgaataatctcactcattttcatctattctcaggtttttagtgatttttctagtaacttaattgtagtaatgtaatatactaaattatctaagtgacaagctaattttaatatcctctaccatcctctatccttctgtgctttattttaaaaagctgtagaaatatatgacattgtgaacatctgagcaggcattttcctttgttatggcagcagacaaaaacctccttttttaaaaaatagcaatatgtcaggtttttagaagcaatgctactcggcttcattttgctgtgactcattccatgtgttttctttggggactctttggcctgagggttggtggcatttttgcatcctggaggcgggcacaatacagtagtgttaccaccattgcagcacaagggtggcatgcccctgtgccacctgctgtcctagccctggctgtaagcagttgcctgccctaagtcctcctcttcattcccttgctgtaactcaccatccttcactggaagcagaggttcagccatcagttcacttttttcaaagaggcttggtcccctggctttcatgctctgggccagccctagctcaggaatcactagttctaaaaacatcctttggtgcttctgcaaaaacagttgggtgtagtgcagcccccaagtccccagaagtttggtggagatggtgggtggaggtcacctccagatttcatgcccgtgctgtggatggaaagcgccatgtgttcagagcagcttctggcttcctggcagccgtaggtgtgcgttagcatggtgcagggtctagtgctgtccttctggagctgaagagaacctggctgtcgctggtaaccatatgactctaaagaccaaagtgtgaccccctgacccttccgtgggctgcacccaagcagagcacttgtccttatgttttcacattgtgcctgctgctcccagagtctgtcgctccttacagctttgtttctttgcctcaagggccacaagatgcttttgctcaaaaagcccccagatcagctgcacccaagccggtctgtcagtgccatcactaccacccagcatcctgccgttaaggctcagtgttttgaagctgggcagtatagcaggtgacatctctttgtatggccacccttggtcatgatgaatttgccactgagtgacttaattcagtgtgctagggaattcaaggcttttctcctctggaacgttgtccatcttaagcaatactgatctcgccataaaatcctgtgtggggaagcagaagttgactagaaagggtttgattgtggcacccacgttgaatgtgttagctatctagagtatcatttgtttcacttttcatcaatccccaggctcagtaggcgtcttcatttggataagattgattattatactcattgcattattgcatggggtaagggacatatgtgttggattgataatcatgatgctgccaatgaattcaaagttttctaagccaaaatggggttcccagagcagcaacatcagcatcccctgagaagttgctggaaattcagattctcaggctttaccccaaatctactaaatcagaaactccaggacactcctccatctgtgttttagcaaggcctctggtgattctgatgtctccgtggtttgagacccactgccatagagcagggctgtctaatagaacgttctgtggtgatgaaacggtcagtatccctgccatgcagtagtggagccactagacaccacatgtggcggtcgagttcttgaaatgtggctgctgtgaccaacaatagcattcatcattttatttaattttgattaatgtaggtttaaattcaaatagctgcatatagctagtggctgtccatcagatagcccagccccagaacacaccctgctaattattattggtaaactcctaaaatgctttaagatgttggttgtggaattattaattttagatcatagaacagaatcttccttactcaattcaacagaattgaaactgcaattgttataacagtagttgattttgattctttgtgtgcaggggagatagtttgtgggctgctggctggttagggaaagcctattcttgagctgattgattgttgattttgtgaatgtgcaccaactgtgcagtgccgggtggctcatgcctgttgcagatataaccaatggcagtagatacatgtccttttaggagtaaagctgttgctcaggaaggggctgtgccagtgtttcgcacagatggactctggtttctccagcctgtccagcaaagtggaggtgcttccggccaaagagaagttaaggagcccttcaggcactttgggctgcttgtggaaccttccagaaactgtgctgcgggagacgggggtgctgaattgccaagtctagggctggcacgtcagatggacaaaactcttgaatcacattcagtttcttcagtttaggagaacttgaaggaaaaaaggtcatgccaggtttgttaggtggaactgctacaaagcccagaagaaactttgagatttgtctctggggtgatgtgaccacatccttgtcacctttccaaaacaccagcagacgctgtaggaagaaagcatccccagcagtcctgtgatcctgcagctagagcaaaatgtgacatcgaggagccagggaatgtctgagtcctttgggacggttcccccaaacccagcaactgaagtctcaaacttaaagcaactgtctttggctacgcagaaaatggtactcaattctttgtcagaagcaaagttctacatcactaagcttcctaattgagggccccattttttgaattatttgaagccctatcattgattttcataatccatctcctgttagaatcctagaatgttaaaacgaggtggaagagaccttggaaacggtcataatccagccttcttattttatagacacccagagaggttatgagttgagtaagggcacacacagcactgtagggtcaaggaccacattgctcttcagtttcttcggtgtcataggtcagctggggtcataggtcagaagctggacagattgatgaaaaaggaacatttcaaagacatgataagaaatatactgatgcacgctattaggttttaaaatgcttcttgctcatgcatcctatagatatctggaaaattccaataaaatattttgagtggtaagatattgcagtggcctttttgaaatagctaaaattgttcctgccacatatgtatatgatttagtcgtgacacaattcatattgctaactggttattttttctggacaactagtttggctgggagtagtttattttccaagcactaggcctgtttcagtttattgactttgataccctgtcttttgtaacttactttccttaaataacatgcccctcctactttacccccaaagtattgagatgctatgtgtgaaaagtatggcactgagcacctaatcagcattctctaagtgttggttcaaagagtgaataccatcccatccagacgggtctgcatgttaatttctttagattttcactatggctgggggttaaaaaaattctgtatatttagggagaatattagctgcgtaattttttttctcatctagcttgaatggagtcttaagcaaaaaattcacatgctcaccaaaaggctgggagaggttttgtaaattgaatatgaggctatcgtttgcgtccacaagacaaagccctaaatcacatttagcataatttgtggttttaaattggactgatttagcaaggagagtgaaataatctctcatcctgtcaaaaaggtgatatctttagagagtatttaattccactggcagagtaacttcaggaagacgacagtaattctgcctgcattattctaggtttgtggctaaattgagatcataaatttctcctgatttcactaactttcattattgctcttcgaactcatcagatgaatgtgctcttcaaactactcagatgaaggcttagtggtagctggagggtggacaggggagggatgaggtctgtgggcagctgcactgtatatactttatgatctggggggagaagatgacatccagtgacttagaagacatagcttggtgattttcttttcctttgagatagagtttcactcttgtcacccaggctggagtgcaacagcgtgatcttggctcactgcaacctccacctcctgggttcaagcagttttcctgcctcagcctcccgagtagctgggattatgggcacctgccaccatgcccagctaatttttgtattttgagtagagtcagggtttcaccatgttggtcaggctagtctcgaactcctgacctcaggtaatccacctgcctaggcctcccaaagtgctggggttataggattataggcgtgaggcaccactcctggccccggtgattttcttgataatcacttacacaagatgaataccattcatttccatggaagtgtcccatggactgtgcacctaagaatgtgcatttgcatccatattttacaggtaggattcctttgaattcttgcaggtatccaagagggagggttctggaggaacttccagctgtctagattaccccatgaaaacctgttcttttatcaacagccacttcaggagctcacccaggggctgctcactagaccactgctccctgcccatgtgccctagttcagagtaatccgtattcttcacagtcccttcttccagtgaaagcgtttcttttacctttcaccaagcattcactctaaaagaaatcaggtcagcgatactgtagacatttcagaaagctgaaaatgatgactcaaaactataattagtcatgttcctgtccctttaattttattccccttggagttatcaattggtgtccttgaaatggctagctgcttaaatattttagatgtatgtttggcgttttacacacacctttgtactggttctaatcacaagtgctcttgggtctgagtttaggtctgactgcaggcaagcaggttggttttctggcctcctggggcacccctggaggaagcagatgggatgggaagtaaacctgacggatatgagacatcacacttttttgggctgggctccaggcacctgttcatgtttttagttacctggatagtcttggtatcagagtttacatgaaccatggccaagcttatcacccatacaaatgtttgtagaatgattgaatagcaaatggaatagatgaattacagcctatggaaagtccttctgctgccaatttatagtttgtccttttgagataaagatgcctttggcttttacatttgtattttcaagtatatatatgctagggaaggaggaaccttttgggtccccagtggttgattttcacctttgatctgcatactagtgttcatagcatgttactgagttgacttttttatttctatataataacaatatatcgatgtgttgcaaatctgatgtaacctttgtgtgtgtgtgtatgtgtatgtatgggtgtgtgtctgtatgtatgtgtggtattgatcaagatacattactccagaggccaaaatcagaaactagggatattgaatatttcgttatttaaagttgagctaatataatgcaatgttaagaggacagctgttcagatactgggttaaacagcttcaatgtatgtcacccaggaagggatttggaggttgctgtctttcttctggtggcaatgcaagaaaaccgaaagaaaaaaacaattgcacttaaaagatcctatatgacagctataagtgtatatgctttgtaatattcacttttataggctgctatggtacagaaattctcttttgtgcatttttgctctgtttccctcctcgttgtccctccgaaacaaactatgccaagcacttagctaatgatatacgaagaagcatttcagcagccactcagaagtgagtgactgcttatgaaaaacttgtgaaaaataagtaagactgataggtgaattcgatggtccttttggagttatatgtttcttagctttgaataaaaacaaaatgtgctgctgccatcccttgctaggagttccattcccagattcacactcagcatttatgtttccatggtggtaccaccaaacatagcagaactgaagaatttggaagtgctcaactttttaaataaccagatcgagaagctgccaacacagatcagcaggcttcaaaaactcaaacacctgaaccttgggtgagtatcagtggaggtgaaaggatggagaggaagagagtggaaggggcgtgctgggtagggccaggggagggattccatttatatcattgcacagaagtggatttctaatttctttttgtgttttgtgttttaaaaaaagttttattgttttaatatatcctttcggtggcctacattagtgaagatttgagagctaattgagaagctaatagttggcacaataaggaagataaatttttactgtattttgtgtccagtaaaattttatctcagctctgttgaccaagaagggacttatttgcatagcatgaactggcagacaagttgtaatatggttgacttttttctctctgtgttaaataagaatagtttataaaggacctttgtgccatggagggaagaatatattccctaatgctgcttcattcatttttgcaattcttctctgtagttgagaggtgacaattctctgtctttctttatgcaaaggtaaagatatgagttttgtttcaactgaggttgcagaaccagggagcagtaaataataataatgataacctgtcttcgtgtattgctttgtagcacttgatcctgtcaacatttgtgaggtaggaaaggcaggttttagtgctttcattttatacagaggaagccaagccttttcaaaggggctaagggactgggtcctggtcacccctgaggttagtggccaagctgggaagagaaccccatggttctgggtctaaaggctccatcagactccattgatatggtctggatctgtgtccccaccaaatctcatgtggaattgtaatccccattgctggaggtggggcctggtgggaggtgattagatctgggggcggagctctcatgaatggtttagcaccatcccctcttggtactgtccttatgatagtgagtgagttattgcaagaccccttgtgctctccttctcctgccatgtaatacacatgctcctgcattgccttccaccacgagtaaaagcttcctgaggcttccccgcaagcagcagctgccatgcttcttatacagccggtagaaccatgagtcagttaaacctcttttcttgtaagttacctagcctcaggcgttcctttatagcaatgggagaacagacgaatacatccatagaccccaactggaactgcaacatcagaattccatcttcattggcacagctattagatgaaactgcccactcatgcttcagtctctgtgcaaagtcgtatactcattaaattgtagccactaaatgctctggttaagttagtgattgacgtggagtggcaatggatgctggccagatatttgccaattttttttaatttttatttttgagacggagtcttgctttgtcaccaggctggagtgcagtgatgcgatctcagctcactgcaacctctgcctcccaagttccagcgattgtcctgtctcagcctcccaagtagctaggactacaggtgcacaccaccacacccagctaatttttgtatttttagtacagacagggttttaccatgttggccaggatggtctcgatcgatctcttgacctcgtgatccacccacctcggcctcccaaagtgctgggattataggtgtgagccaccgcgcccagccacgaacgacatatttaaacactcacagcactgcctgcctggggcctgggagttgtcagttctttggtactgttgagtataaagtgtgaggcaggtggctgtaaggtcagaggtcaggctagacagggaatcctggatatccgctgttcagtgaatgaggatctaccaagttcccaatcgtgtactaggcattgttacagctgctggccatctagccctgatggagcttccattacagttgaggaaaccaactgtaaacaaataaatgtttataataatggcaaggagtcaaaagtgctaatgaaaggcctctgtgctaaataaacaagctcctcctgggcatggtggctcacgcctgtagtctcagcactttgggaggctgaggctggagggtcagctgaggccaggagttcaagaacagccttgtcaagatggcaaaacctcatctctactaaaaatacaaaaattagctaagtgtcgtggcatgcacctatgatcccagctattctgcccagggggctgaggcaggagagacatttgaacccaggaagcagaggtttcagtgagctgagatcgtacaactgcactccagctacgtgacagagtgatattccatctcaaaaataaacacatacataaataaattaatgagctccaattttatcatgctgaccatcgagaaatttgcatagccgagtagtggatatgagatatgaaagatcagtgtggagaagagggtggagggagggaaactagaggttagaagaccagtaagaacataagcttcatgtcccatgtgaactaggagagtgacagtggagacagggagggattttatatgaaaaatatacaggtggtaacgttgacagacagtaactgatgggatggaatgatacctacatttctgttggacagctgaaaaatagaaccgatggagacaggtttgggaagaaaataataagctcaggttttgttgtttggtttgaggcaccataggacagagccgtaaacttttcttctccttttcctttttttttttagacagagttttgctcttgttgcccaggctctagtgcaatggcacaatctcggctcacggcaacctccacctcccgggttcaagcgattcttctgcctcagcctcccgagtagctgggattacaggcatgtgccaccacacccagctacttttgtatttttagtagagatgccattttaccatgttggtcaggctgatctcgaactcctgacctcaggtgatccacctgcctcagcctcccaaagtgctgggattacaggtgtaagccaccgcactcagccctaaacttttctttttcaatgaatgcatgtagttgccttcttgttctctttggagttgtttgcattttgggctgttggcgctttattgattgtgtaaagctttttgtacttaattacacagcaacatagatggagttgtcaaagtttgaagaaaacctcccaattctttgggaaaggagctaagatgggtttcactaaaggatacctctgtcctcaaatggtataaagaattataccacacagtgaggcaagttatagggaggactccttattctaaggagccgggctgaaagcatacacacgggagatcacaaaacggagcagggaagccacgtgtatgcataatccaaaaggcaccctcaataagaatttgctttcaaagttttatatagtacttgcagtttattctgttgattgtaagacatgagagaattttaggccaccggaacaaattaaagaaagttaagttctgttcttaattccttaaatgcagtttatttcatagagttattttccaaaaaatgtgaagccacataggttaccatgttgatgattatttctaggataacttcactgcaggaccactgtgcccaactattcgggaataacgtttgaccttgtttcttgcaagagctagtctcatgaacacatagaagtttttattaagttccatattggttatttacggatttgaattatttatttatttatttattgagacagggtctcgctctgtctcccaggctggagtgcagtgcagtggtgcaatctctgcccactgcaacctatgcctcctgggctcaagtgatcctcccacctcagcctcctgagtagctgtaaccacaggtacgtgccaccacacctggctaatttttgtagttttttctgtagagatggggttttgccatgttgcccaggctggtctcgggctcctgagctcaagcaatctgcctgtgtaggcctcccaaagtgctgggattacagacgtgagccaccgggctcagcctggattttttttttaacttttatttttgataactgtgtgagtaggtcactgtggaggtgagaaaaattagtgcctttagccaagaaggttttattgaagctggaggtgctcaggaccacctgcagagaagaaactgctctgaaaaggagtcattattacagacctttctggggctttagaagaaaaggaaaaaagatgctgaatagacttagaccccctggttttataaatttctccatcatatgcagacatttgcccacttccaacatgcatttgaaaaatcttcccatgcaaacaaagaattgatagcacttggcatagctgagacctgcaaagctttatgtttcaacacctgaagtcacctgagattaagcaagtgtggcacaaatagtaaaaccacagttaatagttcggactatccaaagtggcttgtcatgaggtgagcttgctcgcttagggctgattcaaaattttctctcaaaccttttgaaaaataattctagcaacagctctcatttcctgagaagtcacatctgagccatggatcaggtgttgggtgcttcacatattttctctctcatcctcccagtgatcctgccctgaagatgttgtcagccttattttatagtcgaggaaattcagtctcagagaagctgagtaacttggtcaaggtcacgcagctagcaagtgctggagccagattcctcacctagctgtctcctatcttaaagctccattcttttcctactcccactgtaacctctcatggaaaccttgattgctagcagtgtcagagtggggccctaagcatggaattcctacaagtggaaatgtggatggatggagatggatgttagcacctgctggggggaagggggacagccagcatgttccagccttcattctgcagagagagatgccaccaggtcaccatgcacatggtctggcctccgaagaggtggccagaagtctctgcagttccttgccccctttgtagctggggccgttgctaggagttcttctgaagtttcagcatttgtttaagggcttcctttctgccccaccatggtggtgtgcctactactgttacatactgctgtcagctccacatgggactctgctgtgttccttacacgttgtaggtattggtttgtcactcaaaggaaaaaggaaccttcaattaagtagattcttgccaccaagaggtggaggggctccaggcttgctctgggctggagattgaatgggagttctctctcaggtgagatgcctcttccctctaagcctgtctaaccgtggatttcctatacctaatattgcaaaagtgcatttctttatttgcagagaaaaatgttaaggaatcagcagttttcaaaaacggataacttaaagcagtgtttaaagacagaagcacctagtgtatgcttctctaccttcctttctgtctctgacttgcaattcttctcagaatccttgcatgggagcccaagggtctggaacggctttggcctctgtgaggtacagggtgcttccagacacatgtcaccttcatcagtcacttctgaagtcttttctccttactctctcttaggctgttttttcatctcaagatagcactaattacaagctccatcttgcctgtgttacaaggtaatacaacaagccaagtacttgccataatgtgcttcacaaattgtgacttcatggagaatatttgttgttgctgtcatggcagtagatagtcgtggaggtagttttgctgggtgtagtctgtctgggtcgttttctgcctgagagcgggaacccacgtttccattttggtttctccctctgctgtctgctgtttctggtgaggcctgcttggtaggactggaccgagctggatctgttataagaagcatcgatgactagaatgatttttattgtcatacttccttccatctttcaatatctgtcaacttttattaaagtttttttttaattggcttttaagtatgctcaaagggaacggctttaagaaaaataaggggcttaaagaaaaggataaaagatagtgtagaaaaaaattcccttaacatcacacaccggggcctgtcagggggtggggggctgggggagggatagtattaggagaaatgcctaatgtaaatgacgagttgatgggtgcagcaaaccaacatgacacatgtatacctatgtaacaaacctgcatgttgtgcacatgtaccctagaacttaaagtataattaaaaaaaaagaaaaaaattcccttagaattcatcggagacacacacacacacacagacacaaacacatactgcgtaaacacacacaccaccacacccccatacacaccccatacacataccacaccataccatatccataaccccacacacacaccacacacatacaacacacaccaccccaccacacacacaccccatgcccacccacacacaccacacacacacgacaacccctccacacaccacacacacagcacacccctacaccaccataccacacacacaccacaccccccacaccacacataacacccccgtacacacacacataacactacacacaacaccacatacacacccacacacaccacacacccctgcacacacccacacacaattgatccttcagcaacacatgggtggagggagcaccacactgaccccccatgcagtcgaaaatccacacataacttttgactctgaataaacttaagtactaatagcctacagttgaccggaagccttaccaaaacataaatgccaattaacacatattttgtgtgttatatgtattctattctgcattcttacaataaagtaagctaagcaatagaaaatgttattaggaaagtcataaggaaaacaaagtgcatttactgttcttcaagtggaagtgggtcatcttaaaggtcttcatcctcttcttcatgttgagtgggctaaggaggaagaggagggttggtcttcttgtctcaggggtagcagaggcagaagaaaaatatccatgtgtcattggacccaggcagttcaaacccatgttgctcaagagccaattgtacgatttaaaaaaattttaagttgcaataaaatacacataaaatgtactgtctggctgggcacagtggctcacacctgtaatcccagcactttgggaggctgaggcaggtggatcacgaggtcaagagatcgagaccatcctggccaacatggtgaaacctttctctactaaaaatgcaaaaattagccgggcatggtggcacgtgcctatagtcccaactactcaggaggctgaggcaagagaatcgcttgaactggggaggtggagtttgcagtgagctgagatctcaccactgcactccagcctgggcaacacagcgagactccgtctcaaaaaaaaaaaaattactgtctttgtagtatacagttcaatggtgttaagcgtattcatattgttgtttagccaatctgcagaattttctcatcttgcaaacctgaatcctacacccattgaataacatctctccattgcccctccctccagcccctggccatcaccattctaattgaagataactttgaattttaacagttgtagaaaaaaaaaaaaaccatgattttccctcctaaagggaataaatgaaatgaaataaagcaaaagtctgaaaactacaaagcttcatgtgtatagtttcagatattatcactacattcataaggacgtttttctttacaaggacagatattttgtgatggtttgaatttttgtgtaaaacagtgattcaatttcaccattggagaaaaatgacaactaagaaatttccaaatgtttcaggaatatataagttctctaaaattattagtttaaataagacaacataccacatcatctcacttatatgtggaatgtaaaaaagtaaacctcatcgaaacagggaataaaatggttaccagaggctggagggagagggaaattgccaaaggacacgaaattttagttagacaggagaagtaagttcaagagatggattgtatatcatggtgactgcagtcaataacaatatgtagcatatttgaaaattgctaagagagtgaattttaagcattctcaccacaaaagacaaaaaaatgacaagcatatgatatgaggcaatgcgtatattaaacagtgtgatttaagccattccatgatggattatacatatatcagaagtatcatgttgtacaccataggtatgtacaatcttcatttgtcaatataaattttacataaatgatttttataattaaaaaaaaaataggatggatgtgttgactcacacctatgatcccagcattctgggaggccaaagtgggaggatggctcgagctcaggagtttgagaccagcccgggcaacacggcaaaaaccaatctctgcaaaaaatacaaacattggtggggtatgatggtgtgcacctgtggtcccagctacttgggaggctgaagtggaaggatcgcttgagcccatggaggtcaaggctgcagtgacccaagatcgtgccactgcactccagcctgggcaacagagcaaggccctatctcaaaaaaaataaaaataaaaataaagtataaagtgactctaggatcatggcactctcttacactttcagcctgtgaaactgaggtgcccttgatagtctctataaatgtgtctttggtgtcctgatgtagatttttgtccccctgcaacagcatgaacaggctgaacatttcgccacaaggctttggctccctgccagctcttgaggttctggacttgacttacaacaacttgaatgaaaattatcttcctggaaacttcttctacctgagtaagaaactttcagttctatgaatctcctcaacattatactttgcattctaagagtgaaatttatttgccaggacttaaactccaagagaaattattggacagagataactttttctttagagactccttttgaatattccttcatagctcagcgtatgtgcatttgatatatcgttatgtgacaccattgggctgaagtggacttagtaaagtcatattaacattctgagagagatgatatacctaaatgagatcaaacctcacatttagctaagagacttgactttctttttaaatagcgtgccaaaaaaagatatcctcccatgttggtattaattctttgtacgatattttccaggatgtcccaatcaattaattataaaaatatttattaataaaccactaatggaatttttaaattttccagccaggattcttattttcagccttttaaaaagtactcttattgacctatttatccagtacacaggcattaagaaattattggccacaggtgaacacaccttattcttttatatgccaacaaatttcttgctgaagatgcttttgaaaattaaaaaatgatttcttctgggaactcatgcactatttcagacaaggtttgtttctcttaaatgagtgttctatttcttcaattagtaacttatatggcattcagaaaatctgaattttctgagctggtctctaaaatttcactttttgccttatgtacgttctctctctgtgactttctcaagcacatgaaaccaactgtaaaatattttcttgggtggtgaagcccctgtttttattatgttatattaacatacagttctggagtctgagctccaaagatcacttgaggctaggagtttaagaccagcctgggcgacatagagagaccctgtctctagaaacaaaaattaaaaaattaaccaggcatagtagcatgtgcctgtaatcttagctaattgggaggctgaggtaggaagattgcttgaggccaggaatttgaggctgcagtgacccactgcactccagtctgggtgacagaacgagactctgtctctaaaaaataaataaatactgataaacaaaacatacctctaattatactcagcttttttggttgaggataaacagatgctttagaattttagccttcaatagtttggaatcatattatcattgtgtagtaattgtgaacaaatttctgactactgatattctgcttaagttaggatttactctgttaacttcatgccattattttagtccctttgtcttcatttacttttgtccttaaggctgtagaaacaagtagtaataattagtcagattatggactgatgagctgtagttatagcctccatcaccagaaagcctttcattaatttttaacacaatgctatttacataggaaaaagtctattttaacatagttgcattcccttgaaagaacctttttgccctaggtatccacaaaagtggcacagtagttttctttgttttactttggatgcaaatggagaaataaatgtgaatcaaaagtaatctgtgagaaaaatagcaatcttttttgaaaatgtgttgaaactctgtgccccaaaatgctagtgcctacgttgttaattgtatcagtcctcttggatatagatgttttcctggacacaccagctccacaacaataagccagtaaatgtaagtttgacctgcttgttattattgggagccctaggtatgtcaaaggcttttcaccaagccagggttattaatcaaagctgactccctcgtattgatcagacctcaaatggttgggttccatgccaccctgtttatatattgctgtttaatttgcagccaccctgtgtgcactctatctaagtgacaacgattttgaaatcctgccgccagatattgggaagctcacaaagttgcagatagtaagtaagttatctaaattcttagagaatcaattcactgctgcagccttgtaggggtagaatcaagtcaatctgagaaggagtcaggtttgttttgcaggaataaaccactgcttctgatagtgtttcttgattatctgccggcgcttgtaaataaatggaaaggactgagctgtggtagaagagaggacatggaggaagatgagagtttctgtggagcaccttttaatgtgaaaatgtgttgacaactccctgttttcttctgtttagctcagcaatagggataacaacctgatctcactgcctaaggaaatcagggtgcttacccagcttaaagagctccacattcaggggaaccgcctcactgttctacccccagaattaggtaagtttgctgatgaatgaacttagttctgggtttcatgagtaacaattatcctaatgtagcaattctgaacaacctctctcctcttcttggcaactgctctccacctagacacccagttctgatcatttgagaaccatttgtcattgaccagagttcagctgctataggtttgaccttccccgatgctgtgttctgcagctgtagtctcccgtgtcttagaaactgctgatgaaagatgaccctgctcagctccctgcatgatgtagtggaaaaagcatggggttagtagtaagagccttatgcatggctcctcgttgactagctgggtaagctttctgggtcttggttgttattgataactttatcgaagtatcactcttactttttaaccccttacttttttattgacctagaaaaacttttagcaaagaattaaagtagttgttatggctacttgaagatgttgatacctctcctggtcgtgaatttgcctctctcctgatcccatttctagtaggaattgttaaatatgttcttgctgggaatgggtcctacttctggccactgaatcctaatcctctaacaagtcattcctatttccggagtgggtttatgtcccccgccagaagtaacctccaagccagtcattctgttactgcttcattccactgcaaaaggttcccaagttcccttatcttttcctgtgcagaccctcaatagcctctaatttctttaatcctttgaaccacattgttttctcaaactgcggttatttgcttttctgccccaaaataccatcatttttaagaaacacattaaggaagcagttctttaaacaagtctggcagtttgaagaggccatttgttagaaattagaatgcaagcaccaggagggcagaggcattttcgcatttgttccctggggtgcagtacttgctcagaaaacattgactgaatgaatgaaagaagcaaggaccttggatggcaagaggttaggaaggttatgagcaggccgatggggctaatggttacgcataggaagactgagacacagagcacacccatcagcactgagagttctgttggcagccttattagtctaaagggaaggcagtcacatgatttcatggaacagatggaaagtcccgcctcctcccttcccatttcccttaactctcttgttagtgttaaaagaccagaggtttatttaattatttttaagggctgaggagcaactcaacatttctctttattgagttgcaagcagtcaagttttgttttgggagcagggttacagaatcaagaaacactttttgcgaacaatttcaaggcaaaaagcttcttgtcaaaggagagatcttgggctggacacggtggctcacacttgtaatctcagcactttgggaggccgaagcgggtgggttgcttgagcccaggagtttgagaccagcctgggcaacatggtgaaaccccatctctacaaaaagtacaaaaaattagctgggcattgtggtgcatgcctgtagtcccagctactcaggaggctgaggtgagaggatcacctaagcctgggaggtcaaagctgcggtgagccatgattgtgccactgcactccagcctgggtgacagaacaagaccgtgttgaaagggggaaaaaaaaaagagagatcttgcacagtggttaataaccacaggtgttatcattagtaacagctggggagcttctacagaactcaaacacttgcttcctccccagcctactaaatcaggatctccatgtgtgaggtgaattcttgtgtaacttggtgtaaagctcacttaatgcctctgacatgtgtccttggttagcgtggttagtagaaacagaaaaataaatgtatattttgatgtcatttgatcttatttcatttttcaagcagtgaggcaatgtaggatattagattaaacaattattttatcagacagtaatttgccagaaaaatgtctagttgaacctacacgtgcctatgtatatattttaaaatgttactcattttgcttatcttatttaaatactatatgaggtcatctttgttcaacatttctgttaagctttccattaacaactcatgtatatttttattcaggtgtagaattgagggggaaggctttaaatgactttatttttgccagccatatgtagaaaagcttaatcttaacatttgcctgatagcaggttttcctgattataggcaaacacttagttgtaagtaaatgataaacctttagaagtcactgtcacgagctaaactcaagatgaagacaaatgtactatttatttttgaatggtgattttttttaaaagtcaacattaatataatactaatatagtaacagctattataataataggtagtgtgtattaaggcctggaattgcaaggcactaagataagtgtttttcctgcaatgtcgcctacaattatcataagaattataagcagactttttagaggtgaggacgttgaggtgtagagagggttggttggtgacatgtctgtgggggacacagctagtgagtcacagaggtgagatttgaacctgacagtccctcctctgggtccagcttcctcatcacggtgtggtcctctttcccacccatatgctggtaaaaggattcctagaaatgcagttttcaagtttgaacaaaacacaaccctggcacacccccccaaaaaaagcaggcagagagatgttgctggatggtgagttggcatgggctttgctggtgtgtgagcaaggctagcataacactttgcaaaatgcagctgagatggcctctggaagacaaattgctgccccattccaagtcagttgcattgtccccatgtctctttcccctcaacaaacatgacccccgatgggaacgtcttttttgtttctttgtgtccccaacacctgaggtgaccatatggatgctgctctgggctggctgatgggcagtgccgggcactgatgatgcacatgaagtttatgctgcaggtttgcttctgggggtgttttaaagcatggatgatgatatctccctgtatattttttatgtatctgaatatacaagataaatgcttttgagatttctgtgaaatttcctttcataataaatccagagtttattaacttgtaacctttttggtactaatatttcagccaagcaagagaatctagataagttctgatttgtcaggtctgagaacatgcagggacacagcaaaataaagtcaggggcttagctggagttttaatatgtgactgtattactttccctttattgtgtgtccttgaataagccacttaaaccgttatgtctgatttctaagtagtaaagcactgctttcatattagtctttatacctatcaaaaatgagatgtaagttgagtctctcctgtacccattcattcatttatttattcaggttaagttcctactttagggcagatctttgagtccaaggaaattgcttttccattaaagtaagattcacttattcaacaactgtttgttgagcccctggtatttgctaaggattatgacaagagacagaacacccgttattgatgatgttctagtgggagaggacagaagaaagaaagagagagagaaagaaagaatatgaatgacagacgtgtgatattaagagctctgggaaaaaattgagcatggaagggagtgtccagctggggaaggggtaatcagagaaaccctcactcatagggtggttccctttatgcagagacttaaaggaaggagggaggtctcctgacagagagaacggtaagtgcaaatgtcctggatgggcttgtgctgaggaagagcaaggccgggtacctggaacagagtgagtgaaggggaaagagttgtaaccaatgagcttatacaggaagtggggtctggttcacatgggaactagtaggacattgtcagaacttgggcttttactctgtgtgaaatggacacccccacagatgctcccatcttaatcaccagaatatgagaatctgtattggtgaaacccgcccccaatatttcaacgtaggttctttctattttccataagtgtcggctggctgagaaataaagagagacagtataaagagaggaattttacagctgggccaccgggggtgacatcacatatcggtaggactgtgatgcccacctgagtctcagaccagcaagtttttattaagggtttcaaaaggggagggggtgtaagaacagggagtaggtacaaagatcacatgcttcaaagggcaaaaagcagaattactaatagggtctaacaaagatcacatgcttttgagggaacaggacaaaaggcaacagcagaaccactgataagggtctatgttcagcggtgcacgtattgtcttgataaacatcttaaacaacagaaaacagggttcaagagcagagaaccggtcagaccacaaatttaccagggcggagattttccccaccctagtaagcctgagggtactgcaggagaccagggcgtatctcagtccttatctcaacagcataagacagacattcccagagcagccatttatagacctccccccaggaatgcattcctttcccagagtattaataataatattccttgctaggaaaagaatttagcgatatcttccctacttgcacatccatttataggctctttgcaagaagaaaaatatggctctttttgcccaaccccgcaggcagtcagaccttatggttgtcttcccttgttccctaaaaatcgctgttattctgttctttttcaaggtgcactgatttcatactcttcaaccacacatgttttacaatcaatttgtacagttaacacaattatcacagtggtcctgaggtgacgtacatcctcagcttacgaagataacaggattaagagattaaagacaggcataagaaattataaaagtattatatgggaactgataaatgtccatattaaaatgaaatcttcacaatttatgttcctctgccacaactccagctggtccctccgttcggggtccctgagttcccacaacagaagagttttaggatgtcttccattaacccttataactaagtgttttttagaaaaaaatgaaagtttaaggaactgtttagatttttttcaagaatatttcatagacaacattatgtttttctacccaaacattatttctagttgtctttctttttgtgatattagcagctgttttgaattattttgccaacttggcagcaaccactacagttttctaaaactaagaagcctgtattctagaactctcttccctaaatgaatcctcataaaatttgcaaatagagaaaattcacacacaattccaaagacaaaagtaaagccgaagtcactgtgagcaatttttggcagccaggcatggagactttcacagcttttaacaagtttcttctcagcaattctagcatccagatatagccccatcatagacctcgcatgagcatgtacttcataatcctggtgaatacagaagtttcctggactcttcatgagctgttgctttccctcctatatcagtgttttcagctgaggccatttgtgattgtgtttctgactttctgtaggcaacctgccaaaccttcatttttttttctgcttagatgcacaagaatgtaggcactaattcttatattaaactgtttatttctataatacttaattggctgttttcctggctgaaccaaaccaagagcagcagggatgataacttccaaaactgattaaattagaggtcaagaaattgagccattttaattctattattcttctttcatatattaaatagaaaacttttgtagatagtttttcttcattatttctttggttaccctgaggtactgcttgtagagaaaaggtagaataaatatgggattctttccctttatttaccattttctatttatcagttacttttttatttaccagttttctaagtagtattctgctttcctaaaatcctagaaagcacttgaagaaattaaaaatgggttgatttttttttcttttttgagagagagtcttgctctgtcgcccaggctggagtgcagtggcaagatctcagctcactgcaagctccatctcccagattcacaccattatcctgcctcagcctcccaagtagctgggactacaggcacccaccaccatgctcagctaatttttttgtatttttagtagagatggggtttcatcgtgttaggtaggatggtctcgatctcctgacctcatgatctgcctgcctttgcctcccaaaatgctaggattataggtgtgagccaccatgcctggccaaaaatgggttgatttttcaaaaataaatgttgggaattattctcctgcctcttctcagtctaatgaaatttttctgtaagatattgcatttttaagtactcgaattttaatttttttaagtttttatctctactgagatttcacacatgtttactcaatattattattatttcagtccttgagcatatctataatatagtagtatccccttatttgtggctttactttcctcactttcagtcacccacagtcaaaaaatattaaatataaaactccagaagtaaacagtttataagttttaagtcatgcattgttctgagaaatgtgatgcaacctcccgccattctgctgtatccggttcaggatgcgacatatccctttgctgggcagatccacacttcctgcttcctgctcattagacatttgcagccatctaagttatcagatggacctagcttagtgtagcagtgtttgtgttcaagtaacccttattttatttagtaatggtcccaatatgcaagagtagtgatgctggcaattcagatatgcaaaagagaaacctgaaaatgctttcagtaactgaaaagcagaaagttttccacttagtgaggaaaaaaaatatgctgaggtcgctaacaactagggtaagaattaatcttttatttgtaaaattgtggaaaaggaaaaataaattattgctagttttgcttttgtacctcaaactgcaaaagctacagccacagtgtgtggtaagtgctaaggtagggtttggtattatccatggtttaagagatccacggaggtcttccaaagtacgccccacaggtaaagggggagtactgcagtcttttaatgctaattccaatatctggatgatgtatttattctattgactgcatgctttaatatcattataagcttgatgatttaaacatcaggtgtgcacctgctcattgcagtcatcatcatcatcatcatcatcatcatcattatttttgtttgtttgggtttttttgagatgaatcttgctttatggcccaggctggactgcagtggcatgatcaaagctcactgcagcctcagactcctgggcttaggtgaccctgccacctcagcctctcaagtagctgagactacaggcacatgctaccatgcctgcctaatttttttgttttctatttttggcagacagagggttttaccatgttgcccagccttgtcttgaacatctgggctaaagcaatccatctgttttagcttcccaaagtgttgggcttacaggtgtgaaccaccatggctggcttgtggtcatcattattattgatgcttatattagttcatgtttggatagtgggacctccttcaagttgcctctcagatcctatggacatgatcctggggggtataaacgtgcccttgctttccagtatgacaagatgctctagactgattttgcacattgcctgcctgcagccagaaagcagccatttctccaaaaagctttggttccttttagtgagtgatgatatggagaatccaaagttatggcaccaaggagctttctgcttctgttttgtttaatgcttctaggacttttcagtggattagtctaaaagataagtgcattttttaataaaaaattataatttttaagtaaacctttctgttaacagtcttgattagaggattttaattatgcttagagataatacatctgtatcttcttctatttcatttgaaaagcaccagttttcaatgtcacacccataatgagtcagagtctagctctgtcgcccaggctggagtgcagtggtgtgatctcagctcactgcaacctccaactcccaggttcaagcaattccctacctcagcttccagagtagctgggattacaggcacatgccaccacacctggctattttttgtatgtttagtagagatggagtttcaccatcttggccaggctggtcttgaactcctgaccttgtgatccacctgcctcggtctcccaaagtgctgggattacgggcatgagccactgcgcccggccttttttttttttttttaagacccagtctcgctctgttgcccaggctggagtgcagtggcctgatctcggctcactgcaacctctgcctcccaggttgaagcaattctctgcctcagcctccttagtaaatggaattacaggtgcttaccaccacgcctggctaattttctttttttttttttttttttgagactgaatctcactccgttgcccaggctggagggcagtcgcgtgatctcggctcactgcaacctccatctcaagtgatcctcccgcctccatctcctaaagtactgggattataggcatgagccatcacacccagtcaatataactttatattcacaaggaaacaaaacaatttgtttgactcgctttatagcaatatttgctttattgtgatggtctggaaccaaatccacaatatctttgaggtatggctgcactttctaagcatttcctgagtcagcctactttttctccattttattgccattattctatccatctttttgttttcttgttgttgtctggaaacagaaaagtgctgtgtcgcccaggctggagtgccgtagtacgatcatagctcactgccgcctcgatctcctgtgtccaaactatcctcttgcctcaggcttctgagtagctgaggctacagatgcacgctaccacacctggtttttgttttgttttgttttgttttgtttttgagacagagtctcgctctgtcgcccaggctggagtgcagtggcgcgatctcggctcactgcaagctccgcctcctgggttcacgccattctcctgcctcagcctcccgagtagctgggactacaggcgcccgccaccatgcccggccaattttttgtatttttagtagagacggcgtttcatcgtgttaaccaggacagtcttgagctcctgacctcgtaatccgcccacctcggcctcccaaagtgctgggattacaggcgtgagccgccgctccctgcccggctcatttttaaaaagacgtttgtagagatggggtctcatcatgttgcccaagctgatctggaactcctggcctcaaacaatcctcccgcctcagattcctgagtagctaggatcaatccattgctgaagagtacatggatgttactttgcagactgtcaacctgaattcgtgtttgcttgacattgcctaattattagtttcagtttcagcttacccactttttgtcagcaacatgcagaaaagactgtgccctttttagtgtattgtatcaggaagcatctcacattggtttgtgccgttactggtgcggtgactaccagccacttggttaagatggagttggccatatttctccactgcaaaattacgcattttccttttgtaattaataactgtgtgtgagaaaattctttgagatgaggtatatatctcattctttgtcaaactataaggttttttttaagtgaaagaaaatttattaagaaactaaaggaataaaagaaaggctactccataggcagagcagcgtcactttaaggttttgctgtcaactgatttttgtccaaatcaataattactgcgatgattgaaaaatgattattactaagtttattttcattgtctcaagttctgccaaactctggatccaggctgtgtcaatagggtagtgtggtgcctcctatacctgtctcggcctcctacagtcctttttatttattttgttttttattatagagacagggtcttactatgctgcccagactggtttcaaactcctgggctcaagcaatcttcttgcctcagtctcccaaagtgctgagattacaagcgtgagccaccacacccggccaagttctttaccatcttcagaaggcttaacttgcactttcagcaaaaggatagattcccaggaagactgtgagagagagttggggcctaagttgataataccaaatacactgaacttgactgtgttcaccatgttatggctctagagaaatgagagtgctagtgaggttggtgtcattttgtgtgttttctgtaccttgaagtccctcagaaatcttgcccctggtcttcttgttctaagaacacaacagtttctctttttctgtggagatgaaatatagatctttgattttggaaccaaatttggactcttgactctggagcaccaatttcttcagcaagttgttctctggaatcaatcccagggtatgggtttatcataaatgccttgatgagagtgtgtaattgagaggcgctataggtggtatgacactgtctggcttctctactttgaaattccacaccaggttgatcttgcccatggctgtggcttgaatctaaagtcaggttctggtcttttctggaatctgtgcctagctcttcaattctgggtgacagagcgagactctgtctcaaaaaaaaaaaaaaaaaaaaaaaaaaaaaggccaggcgcggtggctcatgcctgtaatcccagcactttggaagatggagatggaggtgggtggatcatgaggtcaggagttcaagaccagcctggccaagatggtgaaactccatctctactaaaaatacaaaaaaatagccaggtgtggtggtgtgtgcctgtaatcccagctactccggaggctgaggtagggaattgcttgaacctgggagttggagattgcagtgagctgagatcatgccactgcactccagcctgggcaacagagctagactctgcctcattatgggtgtgacattgaaaagtggtacttttcaaatgaaatagaagaagatacagatgtattatctctaagcataattaaaatcctctaatcaagactgttaacagaaaggtttacttaaaaattatacatttttattaaaaattttaaaaatacacttatcatttagactaacccactgaaaagtcttagaagcattaaacaagccttctggactcttctgtattgatttctaaagcaagtttttgtttcatagcataacctgggtaagatttttgattggaggtattgatgaggattttcaattgatcttctgtgaatttggtgtgattgcacctatgatttgctgctaccatcttgtgtgaagaggtgtctttggccatgatggaagagagtcctggaggctgagctactgtctgggagaccacttacagctcatttttaaaaagaaaggttgcatataatacaacataatttacaaatctaaagcttatggttttctgggctttgacaaatgaaaacacctgtgcaacttcaacccttaccaggatatgcatgagtttctacctgaaatcaccagtattctaacaaacagctttgcgttttttgaattgttcagtgcctgtgaggattccttactgcaagtttatgaaaaatatattcagaaggcatagtctacaattactgtttgggtaagtgttttcatcaattgtctgaatatttgctgtgaatttaagtatgctgatttttatgtagttatcctcggagaaacattgtgccatttttcgtgtggaaaccacttgtagaataaacagagattattaccgcacggagttggttgtgatgggcacgtctacctgtggctgccatttgagtggaaggtggaatccgactctggatcatcggcagcctgagctggtactgggctcacactgaccctgggagtgctctatgcgtgcttcaccttatgaggggtgcagcaggaacaaaaatagaaaagtgtgctctactttcacatgttaccaagggacagaggataccaccaaggaattagaaaactgttaagtgaggatgtattcttcttaatagcctttcaaacaaggaatttgaaaacaagattctactcatcccacaccaaaatgtaaacagatatattattttttatattcccaggataattttggttttacttaagcatcactattgccctgaaatgtcaagtcaagtggaaaaataaatgcgaataatcccaccactagcctccagacttgatgtttatgttatttcctttttaaaatgacctttaaaaagttataaattagaaacgtggaaagtagaatggtttcatgcaagaaatactggaataagatccctgttctggccccaaagtcttagacaagtcattcagcctttctaagcgtcagttctcccatctggaaaatgtgggcattcatctctatgggagcttctagctctgtcagtgagtttctgaaacttgcccaggaaggagcagccctagtctgagtgcatgctgcccctgtgcttgccttttgcctccttcttatcctcgaggtagcctgcagactcctcctcattcatctcctaagccagtgctatctgacggcagggaatatgtttccaattctggtcacatctgaaagaaatttttcctggaagattacatctatgacctgcaaagctttatgcttctctctgtattccagatcttgtgttttttttttttatatgggaaaagttacaattttttttttttgagacagagtttcgctcttgtcacccagctggagtccaatggcgtgatctcagctcactgcaacctctgcctcctgggttcaagcgattctcctgcctcagcctcctgagtagctgggattacaggcacctgccaccacgcccagctattttttgtatttttagtagacacgaggtttcatcattttggccgggctggtctcaaactgctgacctcaggtgatccacccacctcagcctcccaaagtgctgggattacaagcgtgagccaccacacctggcacgattatgtctttttaaatgagaaaaatttcttgagatcataagggaaaaaaaaaatccctaagccaaagtaagtcaaccaagaagaaaatgaaaatgaaaatgaaaaaaatatgtattttaaagaaagtaaagtggacatagcagtcactctgaaatctgggtatagaaccaccttcatctctaaagtttatatttagccaaccactattctaagcaaggttgtggtaggaatacctaccaactattgtaggccacatgtcacttaaacaggcaaaaagtaaagcaaagccataattgtggtttgatattttggatattcaatctcatttcagtatttgcatggtctcacattttggaaacaaaattgtggtgatttcacttgtctcttcatatcatgattatacttaaaactgagaaacaaatgtagactaaagaagtaaacactaaagggtgagatcatgcaagttaaacagatatgctttctcaggggaaggtcacttacccatcatgcgctgatatatttttgtgagcttatatggttctagcgtatttacaacttgactaactttacatgattcactgtgtactgtagaatataattaaattgacatttcctggtacagaataaatttgcatatgagcgaaacaaatgatgagaataaataagtctgaggccatataattccactggttaccaatttgtgtcttcagctctacaccaaagcaaatattacaactctgaacaagcaagcaggcgaagaatagatttgctgtaacctcagatgtcaaagaatgcatttatctctgaaaacatttgtatttttttgtcacattgtactttatttaaaggtggccacagcattaaagtgtcagttcattttgtacaaccagaaatggaaaatgagtcagtcaagctgaagcagaagtttctaacaaagtctaaggcatagttctatataactaataataaggatacaatatttggcttactgaattcccaaactgaggtcactaaaatttaagaatatctaccaaaacttaagcgaaatctcagagaaactttaaaaataacattttatttttgatatttcaaaatgtttcaatcaatattctgagcctaaatgtgcaggtgagtgctttctccatctttgcacatgtgaagtgcgcctgaaccatagccccatatttctcaaacaccatcacactcatagaacagaaaggaaagggtagtttcaccagctagcccccacaagccactccctggggtcctccccagcacctgctaaatttgggaggcctgatttcaggggggtggataatgaactggcaaaataaacccaaaagaatcgtaattacaaagaccaactcaggttccagttagacagcccataccagtgcttttgatgttagctgcggttaagggggcaggaaaggctcccactctatggtccgtggcgtggtcagctcagcgctgccaccttggcgggctccatctcaccatgaccctctcaatcaggctgatggtgtctccttatgccaagtggaaggaacttcaatcaaattctgacacgacctgcaaatcctctcgggccctgggctactggttaggccagtagggctgtgtatcaaccgattaaacccattaataactggcagcacagcacggcctccttctcaacaaattacgatgccgatcccggaatcagccatccaggcccatggtcttttgtccttaagctttcaaaacgcctcccctgcttcatgctttctagtcttgaggacttggcttcagcgtgcttctgaattgccgctccctctggttgacaattcttttttttttttttttttttttaagacgcggtctcactcttgttgcccaggctggagtgcggtggcgcgatctcggctcactacaacctccgcctcccggattcaagcaattctgctgcctcagactcctgagtagctgggattacaggcgcccgccaccacgcccggctaatttttgtagttttagtagagacggggtttcaccatgtttaggcaggttggtgtcgacctcctgacctcaagcgatctgcccgcctcagccacccaaagtgctggtattacaggcatgaggtcccgcgcccggccgacaatttacactgttctccagttggggcggagcgggagacactatggagcccacctctgcaagaggcaaggcttggcgaaaggcagagaccccaaccatgggaaggtgcactttgggcaccgaactttagggaaagcgctctgggtcaggcgtctcctccagagtggtcagtttagagttaaaaaggccgccttcaaaatagttttaaaatctatacatttacccagacatacacatttttcgagacagggtcttgctctgtctcccaggctggagcgcagtggtgcggtcgcaagccatcttcctgcttcagcctcccgaggagctgggaccacaggcccgcgccaccacgccgggctaatttcatttcgtttcgtttgttttattttcgtttgtttgttttgtagggatggagtctgactgtgttgcccaggctagtcttgaacctctgggctcaagggatcctccctcctcggcctcgccaggtgctggggattcaggcttgagcctccactcccggccctattaattattcttaattaaaacatttcaaggacgcagtgtttggggccagcgcggcgtttgcagtggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatccgagtcccgccgccctccggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacccgggacatccaggtgggatcggccaccgctcaggcgctgtcccaggcgaacgccgccaggggcaggctcagcaccgcccaggccgccggctcggtgagcgcagagaggggcccccggtttatgccaaacgcgtgtcttctccaacctcctccttaagcccctgtctcataggctggttcctgtctctctccagtagttcctgggtgcctgggagcagagacggcccattctccccaagctcagctgcaggcttcagtgacctgggcaaagtgcggttaaccctgaccaccttttggggaggaaggccggttgctcccctagcctccactgtggcactaggaggcaagggtagccaagctgatcgccggtttcatctgtacccacccccacccccacaggtgttgagatgggcagtgacaggtgggttggcagccggactggagtggcatggctaactgccctgggcaccatattccctgcctgtcaccactcctggctgcccaagtagcaaagcaaagttacaatgacaagatccagagaggggaggctccagctggagatggcgctgctgtcacaggccacctgagcaacaatgtgacagcttctcatgggggcgggatctgtccccagtccctaccccgccctggcttgatccttgtcggtgtctatttctttgccttgctcttatctcagcctggcttcccttccaggatgtcagctctgagtgtctcttggtccacgcttgtctccatctctcctttctcttccccactccctaaactcaggacccagtcactcctgctccttacacacatacacacccacactaacatacatgcactctcacattcactctcgttccccccccacacacacactcccaccctaccttagacaggaaacaagtttccctcccagaacccttataaagacctgtggggaatgaccgggatctgggccccccgtaggtctgtgagtgagcctgtgtgtgtgcaaaggtgtgagcctgtgagcatccatgtggctgtggaatttagaaagcatgtgtgtacacacgtgagtgtgacagtgaattgttgagagttgaaactgtacatttggggtcagtgtggtcttggtcatgtgggcacacaggtgagctccggctagggtggagggatgtgagtgactcggagtgtggaagctgagcccagggcagatggacaaatacatcctttgagctcctatggaggctgccaccccataccttgctcacctactccctctttgtcatcctgggttccgtcaaatcaggatggggtgcaggaagggggagtgaagctgctgacctctgggaaggggcctgcacgctccttgggcctgtcagccactgatctgttccatgttcctataaatacttaaaaatcctagctgctgaggaggaagacatcctccaccagccagctgggggtcctggcctggaagctggtggggagggagctagggagcaagacacatgggggaggggaggggggatcgcatcagcgaggctggcatcagggactcctgagttccgctcctagttttgccaaaggttagcctgggtgccccagtatgtcttcatcaggaactgcagagccagaaataccatctatgcctctgtcccaggaagcagccctacctctgcctgaagagagagactcccccgtcaacagccagctttctgccttctagtcacgtctctcaagtaggggtaaagagaggggtattcttgctttttttgtagtggggagcgtctcactgtattgcccaggctgttctctaactcctagcctcaagtgatcctcctgcctgtagctcccaaagcacaacaattacaggtgtgagctgccacacccagcagcttcttactctttaaacgccagacaaaattcttctggagttcctggaggggattgtctctttgaactgaaaatctttcccaggacacctttatcaatccatcaggctctttctggattggagacagaagaaactgcagttcaatgaccccctttgcaagagccccctctgcagccgttgaggggagcgaaagcattttcatctggcctcacccccatctgcagccagctctttcacttctggagctgggcttgttgtgataacctggaagagggggaattagttgggatgactcacttgctggagcccatcaacactagaccaggcttgtggccagatgcctggttaaccagcccaggagagcttcctttctcaggaagagaatgattattgatcctctatacccattgcccaggacagtgtcaggcacactataggcccttgggcatttgtgtggcatcatcagcattacgcctgtatcaccaagtcaagctttcccaatagcagttggtggcaaactccaactcctagtgtcagaaggcatcacaaagcccagatgtcctgggcctcccagctcaggcaagcctagcgtggacacagaaacccttgacactgagccaatatctcttccccctgtatggcttgaatttcagatatattgatgttgagcccttctggccggcagtgggactccccttggccttacataggtaatgcctatatcctggcctgggcttttccaagaagccagactctgggaaggacctggagtggaggaaaaaacaggcagagggaaccccatgaggggttctggctgtggaaacttgcccctaatggggcatcaaagccaggcacgcaggggctcctgctctgccagaggtttgaagtcaggactacagcttcccatcttactcttgggatacaaatcagctgttttcagatgagagagtctgaggttccaattttataagatgagaagggctgaggtgatgcccattgtgccacttggctgagtccagagctgtgatgaagagggaaaagtcacagggcaggacaaagaaggggactcagggacccgggagttttccttggcagaagtcaacttgccccacccctgagaaaactctgaccttctcagctgccagggaggaaagcagggactggggagaaggggacagggagagggaacagtctggtgctctgcgccctgggagagaagtctgatgacagcagtgactcaggaagggttaagaatattcctaaaatagccaagccacagcttaagccagtccatgaatgcctcttccagagagcagatctgtagcaggaaaagtcagcctgatctttgccccactgcctgctgcctggccctggctgctaattaagcctcccaccctgtccccttcaccaactcctgtcctaatggcgatggggtaggagtagtcagaggagccaaatctcccagatcaacagagaactccagctgggaccaggagcactgggcccaatgcctcccctcccccatccacactcctgagtcaggtagaggacatagggggacagacaggcaaagtgcaggccttctgcatgggatggaggctgccaggagagagcaaccaaattctcccacccacacatatgcatcgccagccatgatcaggtgggacctccaagatcatcatcaactactaccttctcctagctctttgttcccttttacttagggcatcttggagtgagatgcacagggaagggtcgagggagccccttcatgaacaaaccatatctttgtttcaggggcaggactgggtacataatttgcaggacccggtgtgaactgaaaatggagtcatttgttcaaaaaatgttaagaatttgaaggcagtgacaacatagcattaaaccaagttcaggtcccctctgaatgtggggcttttgccattgcacaggtggcacctctatgaagccagccttgtttaggggtttcgtttaatgaacatttactaagtgcccactgctcagctcttctggctctgtaatatggtctggctctgtgtctgcacccaaatgtcattttgaattgtaatcccctcgttttgggggagagacctcatgggaggtgattacttcatgggagtggttcccacgtgctcgtctcgtgaaagtgaatgagttctcacgagatctgatggttttataagtgacctttcccctcttcgttttgcacttctctctcctgctgccacatgaagaaggacatgtttgcttccccttccaccgtgattgtaaatttcctgaggcctccccagccatgtggaactgtgactcaattaaacttctttcctttataaatcacccagtcttgggtgtttcttcacggcagtgtgaaagtgaactaatacactctgtgacctcagagactccctctcagtgaccctgttctcaaatgaatgaagatgggtgctcaaagatctctctctaaacatggaacgggggctatctgaagacacaggtgattaatttctaatcataactaaggtctgagtcttgaagaccttcctctggagcctcattaaatttagttaatctagatgggtccaggtgctgcaggtaattacccttgtcttgtctcttgcaaaatcatggaggtttggagagttcttttagaccccctctcacatggaggtttgttttcttcttttttctttcctgcaaggacaaagtgaattctgtgatggtttgtgtagcgttttttagtttattgccaaaaattgaggctcaagttagtagactacatttttaaatgaaactttctagacaaagaaatgcagctgaaactgttcctttgataccagtttccaaatctgcacagagttgatagcaattttttctctttatctttccctgaattgtatatattcatataaatgctcttaaattattagtgcaacagggtggattgtcattacagagaacgtccttagtatagaacataaatcttcccactgccaactgggctctggtcacaaagcacccagagctggcctttaacttccacttcttgattcttttccttaccttttctatttctagaatggctttgtcatttcacttgtctgtctggtaatatcctcctcctgtaagaatcaacgagttcttgatacatattggtctaaatttgcctcctgtttgaacctttttccagttttccaggcaaggttgatttatctgtcttctgtgtctccataacaatctttccaagcataatacagtaaaaagagagctgattcatcatgtcctctccgtttccctctggagacttgggagctgatgtgagggtacaggtatgtccctgtataagctctttggtcgcctttgtcagtttagcacagttctcggtatataattgttctcaggtgccattaaactggacctgaataactgaaggatcgaaagtgttcaggaatcacccaggatgcttcaataattcatcctaattagggatatggggaaactgcatgagaaagaagttttttttttttgaactttgaggataaattaaaattcagtaggcagaatgataatatatgttgataatttttattttaaaatgttcatttttaccattttgatataatagtttattttttaagaaaaaggcagaaacccctgcttattagaaggcagattttattgattttttacccctagacttgttgcatatcaaacctatataaaaatatctataaatcaaatcattaattgtgcctcgtataataattctatatatggatgtaatgtttgattcttcaggagctttaataacttgaaggcgctttgattgctttaaaattatttctcattgtatttgtttatattgtatcgttaagcaaaagtacagagtaagcaattagtgtgattaattcctcttctataatacagtaaagcactgcctccctagaccaattctctgggatccctggaagacatctggcatccagcaagtctttacccctctttagaaagccgtggagaaactgggggcaattctgttacttatttgccctctagaggcaattccattaattaccctccctcacctatccatggcactatttcttcagttacatgtagaatgctgttatgtgtctcctggccagaccctttatttcacagatgtggaaattgaggccatgaaggatgaggtaattgttcagagtccacatgactagttactgcccagagcctggcctggacttctctcttgttctgaggccttgagttctctccctcttctttagtgcatatgaccagaggtaacataatctgcgtaccagatggttattttccatctttttttgtttgcattataatagccattttaatgggtatgaagctgtacctcactgtggtcttgctttccatttcccgtatgacttgtgatattgtctgcacatattttaatgtttatacactaacagagctgattactaggggtgtgtgcgtaaggggaactgtgtggctgctgagtggcttccctgtgggatgatcagccagaacccgctattgtattaggggaatccccagatgtcaccgtctatgggtctttttcagtttttatgggtacatagtaggcatatatatttatggggtacatgagatattttgatacaaacatacaatgcataataatgacatcagggtaaatgggatatccatcatctcaaacatttatcatttctttgtattataaacaattcagttatacgcagttattttaaaatgtacaaaaaaactattgtagttaccctgttgtgctatcaaataatagatcttattcattgtaactgtattttgtacctattaactatccccacttccccccaccgactgcacttcccagcctcaagtaacaaccattctactgtatcttcatgagtttaattgttttaatgtttagctccccaaaatgagtgtgaatgtgcaaagcttttctttctgtggctggcttatttcacttaaaataatgtcgtccggcaccagtccatgttgtcactaatgacaaaatctcattctttgttatggctgaatagtactccattgtatatatgcacattttctttatccattcatctgttggtggacacttaggttgcttccacatcttggatattgtgaatagtaatgcaataaacataggagtgcagctatctcttcgatatatttattttcttttttgtgtatatatctagcaatgagatggttggatcatatggtagctctatttttagttttttgaggaacctccaaattgttctccatagtggttgcactaatttacattcccaccaacagtatgcaagggttcacatttttccatatcctcaccagcatttgttattgcctgtcttttgaataaaacccattttaactggggtgagatgatatatcctcatagctctgatttgcatttctctgataatcagtgatgttggtcaccttttcctaagtctattagctttttgtatttcttctctgagaaatgtctattaagaccttttgcccattttaaaatcagattattagatttttctctatacagttgttttagctttttatatattgtggttattaatcccttgtcaaatggacagtttgcaaatatgtttccccattttgtggattttctctttgttgattgtctcttttgctgtgcagaagctttttaacttaatgagatcccatttgtcctcttttgctttggttgcctgtgcttgtggagtattgcttaagaaatctttccccagtctaatgtcctggagaatttccccagtgttttcttgtagtagttcaacctaccaagattgaaccatgaagaaattcaaaacctgaaccaaccaataacaaataatgagatcaaagccttaataaaaagtattaacaaagaaaatcctggaagcaatagcttcactgctgtattttaccaaatatttacagaagaactaataccaatcctattcaaactattccaaaaaatagaggagggagaaatatttcaatgcctgatacttaaatcaaagacacattaaaaaagaaaactacaggccaatatccctaaggaaaattgatgcaaaaatcctcaagaaaatttacaggcaaaacaaagtccacaacatattgaaaattattcataatgaccaagtggaatttatgccaagaatggaaggatggttcaacataacacaaatcaatgtgatcatcatatcaacaaatgaaggacaaaattcataataatgtgaattgatgctgtaaagcatttgataaaattcaacattttattgtaaaaacccttaaaaaaacagggtatagaagaaacatacctcaacacaataaaagccatgtaagacacacccacaagtagtttcttactgaatgggaaaaaaactgaaagcctttactctaagatctggaacaagagatgcccactttcaccactctgcctcctgagttcaagtgattctcctgcctcagcccctcccaagtagctgggactacaggcacatgccaccacacctgactaatttgtgtgtgtgtgtgtatttttagtagagatcgggttttaccgtgttagccagaatggtctcaatctcctgaccttgtgatccgcctgcctcagcctcccagagtgctgggattacaggcataagccactgcgcctggcccttcctgtcttcttctaagctctccaaactgttccaacctctgcccattacccacttccaaagctgcttccacattttcaggtatctttatagtaatgctctacttcccagtaccaattttctgtattagtctgttcttgcaccgctataaagaactacctgagactgggtaatttataaagaaaagaggtttaattggctcacaattcttcaggctgcacaagaagcatggctgaggaagcctcaggaaacttacaatcatggcagaaggtgaagagggaggtggcacgtcttacatggctggagcaggaggaagagagagcaaaaggggggaggtgctacatacttttaaacaatcagatctggtgagaactcactatcacaagaatggcaagggagaaatactccaccatgatcctatcacctcccccaagaccctcctcctacactggggattacaattaaacatgagatttgagtggggacacaaatctacaccattttcataaggttaatattaaaaattatttgctttcctatatgctagcaatgaaaaaaattggaatttgaaatttcaaatgcaatgctatttacatgagtacccccaaaatgaaatatgtaggcataaagtaaacaaaatatgtacaagatctatatgaggaaaacttcaaaactttgatgaaagaaatcaaagaaaacctaaataaatcgatagatatttcatgtgcaaggatagcaagactcagtattgttaagacgttaatactccccttcttgatctatagattcaacacaattccaatcaaaattctagcaggttattttgtggatatcaacacatttattctaaagcttacatgaagaggcaaaagactcagagtagtcaaaatgctgaagaatgacaactcagaggactgacactacccaactttaagacttactatccagctaaataattgagataacatggcattagtgaaagaacaggcagattgatcagtggttccaaagagtgagcccagaaattgacctaggcaaatatagtcagctgagctttgacaaagaagcaaaggcaattaaatgaaggaatatagtctcttcaacaagtggtgcttaaaaactgaacatccatgtacaaaaaaaaaaagaatctaagctcagactttacacccttctcaaaaattaaaactcaaaatggatcaaagatctaaatgtagaatgcagaatcacaaaggacagaaaaccaaacaccgcatgttctcactcataggtgggaattgaacaatgagaacgcttggacaccagggacggggaacatcacacaccggggcctgtcatggggtggggggatgggggagagatagcattagcagagatgcctaatgtaaatgacgagttaatgggtgcagcaaaccaacatggcacatgtatacatatgtaacaaacctgcacattgtgcacatgtaccctagaacttaaagtataataataatttaaaaaaatctagaagatcaaaggagaaaatccaggtggccttgggtttggtgatgtgttttcagatacagctaagggcaggtgcagtggcttacacctgtaatcccagcactttgggaagccgaggcgggcagatagctagaactcaggagtttgaggccagcctgggcaacatggtgaaacctcatctctaccaaaaatacaaaaaattagcaggtgtggtggtacgcatctgtggtgccagctacttgggaggctaatgggggagcattgcttgagcctgggaggcagaggttgcagtgagctgagattgtgccatggcactctagcctgtgtgacagagtgagactccatctctaaataaataaataagacacaaccaaaagcacaatgcatgaaagaaaaaaattggtaagttggactttattaaagttaaaaactgttatgagaatgaagatgggagcaagagatggggaaaatatttccaaaatacatatttaataaaggacttgtatccaaaatatacaagtcttttaaaactcaacaataagaaaatgagcaacatgattaaaaaataccaaaagaggccgggcgcggtagctcacgcctgtaatcccagcactttgggagactgaggtgggcagatcacaaggtcaggagttcgagaccagcctggccaatatggtgaaaccccatctctactaaaaatacaaaaattagccaggcatggtggggcatgcctgtcatcccagctacttgggaggctgaggcagaagaattgcttgaacccaggaggcagaggttgcagatcgcaccactgcagtccagcctggtcaacatagtgagactccatcaaaaaaaaaaagaagaaagaaagaaagaaagaaagaaagaaagaaagagagagagagagagagagagagaagagaagagaagagaagagaagagaagagaagagaagagaagagaagagaagagaagagaagagaagagaagagaagagaagggaagagctacttgggctgaactaggacggtcgcttgagcctgggagtttgaggctgcaagggagccttgattgcaccactgggtgacagaatgagaactggtctcaaaaaaaaaaaaaagaaaaaaaagagaaatgagctatcaaacaatgaaaagacatagaggatatccaaatgcatattgctaggggaaagaagccagtctgaaaaggttatatatagtacagatccaactatataacattctggaaaaggcaaaactatagagatggtagaaagatcaggggttgccagaaattttgggggagggggatagatgagtgaagtacaggggatttttagggtggcaagattattctatatgaaattgtaaaggcggatacctttatgcatttgtcaaaactcagagaattgtacaacagagtgaaccttaatgtgaagtatagacgatagttatttataatgtgtcaataatggttcattcattttaacatatgtaccaccacaatccaagacgttaacaatagaggaaacaggcagggaagtggggtgagcagatggaattctgtaccacatgctggactggtctgtaaatctaaaactggactaaaatatgaagcatttgactgcttaaaatactcagctgatgagctcaacaatagaatggaggtaacaagaaaagaattggtaaactcgaagatagagcaatatgaacaatggagagaaaacaggctgtaaaaacgaacttcaggacctgtgggatccacatggaatacctgacattcctgccattgcagtcacagaaggagagtacaaagaggtggtcctcgaaacatatttgaagaaatcatgaccaaaaacttaccaactctggcaaaagacaaagctatagacttaagaagcttagcttagtgaccaccaaacaggatgaacacaaagacattccaagggacatcatagttgaacttctgtaaacttaaaggcaaataaaaagtcttgaaagctgtgagaaagaaatgacacctcatctataaagggaaaacatcacaagtgacaatagatttctcatatggaactctgaaggccagaaggaagtggcacatttttccccttattgaaagaaaaaaaaccccatcaaacaaaaatgccctgcaagaatggacaaatgggcattctcagatgaaggaaaactaagagaatttgtcgctaacaaacgctctcttaagagtggctaagcaggccgggtggtggctcatgccggtaatcccagcactttgggaggccgaggagggaggattgctggagcccaggagttcaagaccagcctgggcgatgtagcaagaccccatctctactattaagaaaaaagaaaattagctgggcggtggtggaccgcacctgtggtccaaactactcaggaggcttaagtgggagaatcacttgagcccaggagtttgaagctgcagtgagccgagatctcattactgcactccagcctgggcagcagagcgagatcctatctcaaagggaaaaaaaagaaaaaaacaacaaacaatggctaagcacagtcggccgggaccagagaatctggcttcctaaaccaagaaggcgggccagcccaggacaggcggtggggaagaggcgctgcccaggcaggcgtctcccagcagggccgcctgcgggcgtccatcctctgcgaggccctttgccggccaatcgcgtgctgtggggaccacagaagtccctctctgcttgagtgagtgaacgctaccagcaactggtctccgtcctccaaagctgagatgagagcctcacagcaaaagcagcagcgttagcccgtacatttatttaacggaagagttatttatagcaatgcaccaaaaacaagcaggttggtactttttttttttttttttttttttttttttttttttttttttttaggtggagtcttgttctgtcgccaggctggagtgcagtggcgcgatctcagctcactgcaacctccgcctcccaggttcaagcgattctcctgcctcagcctcccaagtagctgggactacaggcgcccgccaccgtacctggctaattttttgtattttcagtagagacgtggtttcgccatgttggccaagatggtctcgatctcttgacctcatgatccacccacctccgcctcccaaagtgctgggattacaggacgctgcaggttcaaggccaaggcactggccagccttacgcccgcgagctggacccggcccagtccttgttagtcctcagctccttccccgcctcaggaaagtcgcgtcctggtcaggaggacctgccgactggtctgcgcccagctgcaggttggtcctttctgctgctgttgttgctgcggtctcacccagagttgcctctcctcgcccctgacagagcaggggcatctccatcttgtacaagcaccgccatcttaaagttccccttgatcaaaaactgcctaaatctaaaggtcatcagcctgatggctacggtcagcatgaccataaaccacaaatgacatctctgaccagaaacattgcaaccctaagataaacccctctccgaccagagacatgccagccctgagataacatcccctcccgcgggagacattccaaccctgccataaacttctcccccacacagaaacacttcaaatctgtgataagctctctcaccctaaaacactcctagtctgtaagacagaatgctcctgacagaaataggctagaagcccctcaggtttattctccaaaataaacctgtctttgactgttgagccacttttcatgtttctttcctttctttaactcttacagccccctcgccctaaggacacagtgtgggctgttgcaggtcctcctgaccaggacgcgacttccctgaggcggaggaggagctgaggacgaacaaggactgggctgggtccagctggtgggcgtagggctggccagtgccttggcctttaacctgcagcgtcctgggtctctttggcccagccagtcgtgaggactgtggcccaggatgctgccgaacagtgagggtgcccattgtggactggaatccagctagctattcctcattcgagaccccatagaaccccacaaacatgattggggttgacatggattttgaatattaaagttacatgagatttctgaacttgagtgtcatggagcaaatttcaaacgtggtgtgtgtgtgtgtgtttgtgtcacacttaagagacaaattacaagacaggacaccgagtccttcacccgcctgcagtccagccttgcaagccgtgggggcatggccttccactgggggcgtggcctcctggcgcgggcgtggcagggcagcacagcctggctgaggaaagcacaaatcctgctctgcaactgctggctccgtggccttgggaagtcagcaccaactccccagggtttttgaggaggtggtgtgacttagtgactgcaaatgcaaggcgtgccttgccttccactgaacatgcgcagtgttggcgctgttttactgttttcttcattgcttgcacttttgactttcactttctgctgtacccattcccaggcccaggattgggttcctccccacccctttcgttactccctgaggaaccagctctgaactgtggatccctggagtcccacatggagcccctcctcaagtgtaccatgatggccccacctcaggacccacacacacaggtggctgagaaacagggcaacatgcagagggaaaaccaggcaccacgttccgggattcaaaggcaaatttgacccaagcagttcttcatccagcaaggcattaggctgaaacccctgtctgcttctccgcagctaatctttccaggcttccctgctgatttcaggatccaaacctcctctcttaagggctctcaccactcccccagggacagtgccctctgccacaccaggtcccctctcctggccttccttcctgacatgggctttcccctctcccaggaagcccctcatgctcacctgatgtgattcactgaatcaccccagggcctcacacactgcccactccataaacatgtgacctgaagtgggtttattacttacagattggctgtgagggacaatagaagcctaggtttcaggacaagccagtcctccaagcctcaggaaagctgtccagagtggatggactctcatctgtttgctccacttgtaccacaactaagagaccctgcagagcagctggcgctgggtgttatactcaagggtagtgggaattgctgggctaaagcattggagaacactctgtttctagagggaacaagaacagagcctgggctgttttggtcagttcctccttatctcaggatgttgcattttcagcacattctatagttattctcgagaactataagtaaaaaagtgggggccgagcatggtggctcacgcctgtaatcccagcattttgggaggctgaggcaggtggatcacatgaggtcaggagtttgaggccaacctggccaacatggctaaaccccatctctactacaaatacaaaaaaattaaccagacgtggtggcaggtgcctgtaatcccagctactgtggaggctgaggaaggagaattgctagaaccctgggggcggaggttgcagtgagccgagatcacaccactgcactccagcctgggcaacagagtgagattccattcaaaacgaaaaaaaagaaaaaaaggtggggagaactgcattggcccaagccacccaaagaactgtcctgcaagcagcattaagctggtttctgttacatccaaggagtggctcttatcggctcttggtcatggtctgtgtcatgcagcaggatttggtgagccacagttataggcaaaagccatgtctccaggatgaaccacatgggtaccatgttcatagcagccaggacactggaaaccaggaacttgtagacctcttattgatggcagtggtggcctgtctgaagtggctgctgccatcacactggctgtggcaaggaggtgcagccagggctgcacattctgtggaaccagcagcagctggagacaaatgggagccccactcattcagagttggtggggtgggagctccctggatgcagccgcagccacccaactcttggctatggacccagccctcctgctccatggagcaagaaggagccacacccactctgggcacagctgtagctgcccaagttgtggctgcagacccaggcatccttgcacccttgggggccagggaaggcccccccttgcgggcttgaaaatgcctgctcccactgcctggcttctccttgctgttggcaccccctccaatctcagagcaaagtccagctaagcctgggtgctgtcacagcctagctgggtgtgcacctgcttggggcagtactgacacaccagcccgctgccacctcagcaccctccagactttaggcactgatgagcataggagggaagctgatgggggcctgagggcagcttggcgctgacctgcaggcaccccttggcacctacagccttggcgccatgagaagcagcaggaggcagacaggttatagggtgggggggcgggcaggtccctggtgaggccccaccttcaggtcagggatgtcctgaaggctggtggccaggacggcagtcccatggaccatagtgggaaattgtgatgtcttttccagcccacctgtggcggtccatggaccaatcagggtggcatttcctctcctctgaggcccataaaagccccaggctcagccagagctgagtagacatcaggacaactagctacagagaggagccacccacttcagggcctcctgtctgctgaacactcaacatgatgaccagctgcagggaggagctacccattccggtgcttcctctgagctattctgtcactcaataaagcacctcttcaccttgctcattcttcacttgtctgtgtacctcattcttcctggatgcgggacaagaactcaggacttgctgaatagcagggctgaaagagttataacacaaacagtgctgatacatgtcccttgctccccatgttgcagatgaagggaaggagagaagagctgcagcccttcagggagcccagacctgggagctccccaggccagggctttgactccctctttggggccttgtggttcctggaatcttcaagcttctgggcaccactgtgttccctggtggcagctgtggaagctgcttgcagtgtccctagttcagccacagcttcacagagagctggtgcccatgccggcacttggaactgcccatcccactgcagcagccggcatgcttgactgtgcagtgaccagaccccatgctcacttgctcacacacccctcactactccatgcctggcttacccttggcaggcctgggatccaggctggtggcgtgagctgagtgcagcctgccaggccaagtgagtggaatgagctgagtgagtggaacaagcccattggtcctgaacaaatattgggcaatggctccaccctccacagaggtttctggccagaaaagtgaaaccccaaggatcctgaaacattattggttctcagtgaggggtcccaggaccaggagcaacagcctcactggggaacttgttgaaatacaaattcccagcaccaagccaagcactctgaatcagaaacctgagtggagctggcaatctatgttttaacgagccttccagaatcgatgcataccagcgtttgagacctaaaggggtgcctagacaccctgggcagctttcctgagccttgggagtgccatccactgattgactggggccatcagcccctctactcttgcctcctcatatccacctccagcctgtttctgaaactgtttccaagaggcttgtcctgagtttacagcaaggcttgtccttctgtcttctcccatccctggaactgctcctcgtcagttcttttcctgctgtggaagccctgggatatggagacactcctgtccttcatgcagagcatctagatgccgctgcagggggtgagaccacacagactgctgcactctgttctgcgtgcccctgaccgactgcagcttcatcatcataagctcaggacaaggtggtcacactgaccagacctggcccagcactcatcctagtgagccacttcccaccctggtggcttctctgctgggcgaatggcctgcaagtgacctgactgcatcccatttcccagtggctgcccccctgagcctggaaaacagggaatgtggaggaagctgcccatcccacccacaggccctctggcttggacagcagctcctttctccacaggagcctcctgaagacttcaaaagcagactctggaaaagcatatgtaatcttggccttagtggggtttcctgggtccaaaaatatgtgaaattggatctgatatggtttggctgtgtcccctcccaaatctcatcttgaattgtagctcccataattcccatgtgttgtaggagggacctggtgggagataattgaatcatgggggtggttccccccatacagttcttatggtagtgaataagtttcacaagttctgatggttttataaggggaaacctcttttgcttggctctcattctttcttccctgccatcatgtaagatgtgacttgctcctccttgccttctgccatgattgtgaggcttctgcagccatgtggaactgtgagtcaattaagcctctttcctttataattacccagtctcaggtatgtttttattcgcagtgtgagaacagactaatactgatgtgagcgaaagcaaaaaaaaaattcatttttctgaacatgcatcaaattatccaagaaatctacaagttcagataagctacaaaccctttcttgaaggagacccttagcaacctcttgaagtttcctggatgtaaatgggagataacaatccataattattaagggaaggagatgtgggcaaaaaatgtaaaatgacaactcactgactacaaaatgcataacttaaaaacatgaaaacaattcaacttcatgaggaaaaaagtgcaaactaaggaagggctgggccatcctgggttagagccagcaggtggtaaattgcagaatcttttcacttaaatacagtctgtaagtgacttcattttgaccaaatatatatatatacatttagatacacatccagaggccagataaatagcttctcagctctcggagatgtttagactctgagccccctttcatctgtgaagttcacttccaccccctcagccttcagaggaaagctgcctctccctcctctgaatgatttcattctgtctcccacctgtcactcttagtgatccttcttctaggtctgtccccatcagaacctaagtttccagcatcagtgccacttcctcctcaaagctgcctcactcctcagtgcctggtctggttccgagaaccactcgtgaagtttaacaaaatccttgtgtgcacacctgaaatttagccagtggctgcactgatggcaggtgttttgactttaataaagtcacaacacactgcgttcctctcggacctcattgtcaaacgggctacacaaaactgacctcacaggtggttgtgagaaatggaagaatgcatgtagtagtggtcacttgtatcattatagtcattgccaggtgctttcaaagtttctatttcctgatgcagagatatgagctggcccctttaccactggattgctgtatggccttggcccattctccctgctctcttcgcatcaggctttctatctgtaatatgggtgtttgactaatgcgcagtatcctttgaaacagactctgatttcccttcatattccctgcttcactttccaagaggaagagggaaggggccctctcaccctgactctggcctttaggatgtcacaaggtactctggactgtttgtaaaccacccccaacctatacatatgctaaagcttaatgagatggaattaggaggtggggcctgtgggaggtgattaggtcataagggtagagccttcatgaatgggattagtaccctcataatgggctgaagagaaaagggcttcctcatctaccatgggaggaaaaatctagaagctgccatctataaggaagcagccctcaggagatgtggaatctgccagtgccttgatcttggacttccagcctccagaaatgtgagaaataaatgtctgttgtttataagccacagaaatttatggtattttgttagagcagccccaatggaataagagacaaggtaggtggagtttgggttcacctacctccagacactgcctttggatgagggctcctgcccctcccacttgaatcaatccctcctcaaggagggcattttacctgacacctccaatcagcccccaagtgaggctccctccctgcagaaatccctgacctggctctgatgaaccctttcctttcaaaaccaaacagcaggagaacagggcctttgatgggtctcgacagagccccctgagcagtgtgccagtgccaccgctgctatacagagctcctacctatggccaaagggccccacattcactcactaaccaaagttcccttttctaagatcccttcgtcctttctaactcccagagaccatgggaacccctacacgttgcccagcaatctcctttcttgatctctcacaaaccccacctgctaccaaactccccttcagggaccgttgctcggacctggtttccacgggctacttctccctgatgctctgccccctacaacctgctgtcagaaaaccttccatcctctgcctccatttctgccacgtctgattaatacccttgccctgtcattctttttctcaacacgaatgtccacccaatgcatgcttctcctaaacattctgccaatttcttgtttctgccagcctcattcccattccaaggatttccctggttagttacgtgatgccctcagctcccaccagacctctcacccagaccctgcctcccaccagctcaccctggtgggagctcagccactgggagctcattcagttggcttctggcctttttgacacaccaatatccttcagtttgtagcaattccttactttctggcactgcaagatgcttcaggctcctcttacatatttcctaccctagccctagactcagccatttctccaaggagctttggttccttttattggggaatggttttagaaaccgagatctgggagctcagtgtgcacactaatgctaggatgtcattgcttttgggcatactaggcaaacagagctaagacacacacacacacacacacacaattttgactctaatccagtaccacaatgttcattctagcttgctcactgtgacttctctctccaacagtgagaaatctggctctcactatccatgactcatttattcaaccttaatatgcaggtaaagccatctctgacttgttagtgcatatcccttggagaaacaaatttaccaactatagtacaatgtttgtggacaattccttttatccttagcctttcagtttctagtcataatatcactttccaaagttacttaggccagtttgttttttctccacatgctccagtgacattatgtcatacatttatagttcagttaggtcatttgttacaagctgcattccatcctgggattctccagacatcttggttaatttttaaatttctcatacattaaagatcccccttcctcatgtatggttctatgggtttgatcaggatacagtcatgtaagcacttcctcagtatgatacagaacagttccatctccttaaaattctctcgtgcatcctctatgtagttaatctgtccttttcctcagcccctggcaactgccaatctgttttccatccctacagtttttcattttctggaatgtaatataaacagaacctttggggatggcttttcactagcaaaatgcatttaaaatccatccatgttatagtgtgaatcaatagctcacttccttttattgccaaatgattttcattgtatggataccacagtgtgttcatccattcatctgcttaaagatatcttagtgacttcactttggggtagttatgaataaagctgctatacatatttttgtatggacaaaagtttcaaatcagttggctaaatagctaggagcacagtttgccacattaaagctcagtaaattgttacaaagtaaacacactcatcagctagcacaagcaacagaacagccctcacccagtcgtacattccctcctccacaaaagtcacaattatcttcacttctgttgccacacgttaattttgcctgggttcaagctttgaatggatcatctggtatgttcttctttgtgtctggcttctttcgctaagtatcctctgtgttggtgcatgtggtggttattttcattgttctatatccttccattgcaaatatatattacagttttgtctttaggtttttgctggtggatgtctgggtttttcccggtttggataatgctatgaacattccttttttatttttagacggagtcttgttctgttgccaggctgtagtgcggtggcgcaatctcggctcactgcaacctctgcctcccaggttcaagcgatcctcctgccttggcctctcgagtagctgggactacaggtgtgtgctaccaagcccagctaattttttgtatttttagtagagatggggtttcatcatgttggccaggatggtctcgatctcttgacctcgtgatctgccctccttggccacccaaagtgctgggattacaggcgtgagccaccacgcccagccaaacattcctatgtgcctttctgtatctacttctgttgctggctcataggtaagtgcatgctcagtaataatagacatgctgaaccatttccaaagcatttctaccaatttagattaccaatggtgccttatgttttaacaggagccctctggctgcttcattgaaaactgactgtttaagggcaaaggtgggagcagggaggccaagggaaaggtttcgcagtcatccatgtgtgactgcatggggcacagcccaaaggggtagcagtggaagtagtgacaagtggttggattctggttgtacttcaaaggtagagtcaacaggaattttctgatggattggaaatggaggatagaaaaagcgaatagacaaaggtgtgtgggaggcattttgactaatcatctttatggatggaattgccatcaactgagattataagactgctgatggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactagggaggctgaggcaggagaatggtgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaaagactgctgagcagttggtttgagagggaagatcctgagttctgtttggcacatcactttggaaatgtctattaaatatccaaatggatatgtcatggaggcagctggagttcaggttagaggtctgagtcattgataaaactttgggagttgttggcaaatgatagtgtattggtcagagtctaattaggaaagagaagctacacagtcatttgaacaggaaacatgtatataaagaagtgttaattgcaacagggaagtggagtaaccaggcacagactagtaggaagtataggaggagcaaccactagcctagggctgaggtagagagcccaggagagtcctctcctcctagtgcactgcccctacacctcatcagaggaacccagctatggccctctgcatgtcaggagagtcactggtgctataccactggaacttactagaaatacttctttaggtgctggggaaaggagcggtgtctcaaaagagttactctataacaaaactgcctggagctggtgaggggagtgggacctgctgggcactggccactgtgtttctggagaagtcacccacctgcaggagccaggccagggagcataggagaaccaggaacaaagactgctttcgcccacaaagtctctccattgctctctactgacaaaacctaacataatgtcagaggaaaatatttaaatggcccagttccatttttgcagagcaggcaatgaagaatgagtttgtagcagagatgcaataaattgataactgtattagtccgttctctcactgctatgaagaagtacctgagactaggcaatttataagaaaagaggtttaattggctcacgattctgcaggctgtacaggaagcatgacagcttctgcggaggcctcaggaaactttcaatcatggtggaaggtgaaggagaagcaggcatgtcttacatggctggagcaggaaaaggtggtggggggaggtgctacacactttttaacaaccagatcttgtgagaactctatcatgagaacagcactagatgaatggtgctaaacctttcatgaagactctgctcccatgatccaatcacctcccaccaggccccacctccaacattggggattacaattccacacgaaatttgggcagggacagacccaaaacatatcaataactgatacagatggcatataaaactgagacagaattagatcatccagggaataagtatagacacagaagaaaagaaaactgaagcccgaaacctatggcctcactctaatttaaacaggtgagagcaggggaaccagcaaaagcagctgagaaagagcatccagggctgcaggtggagtcctgtgagacaagtgaatcaaagtgaataggagaggggccagagtatgtattgactgttcttttgtgaagttttgctgcaaaggggaacatagaaaaggtgcaggtcctggtataggaaatagggtcgagtaatttctttgttttgaagatgagagaaatagctgcatgttatgtgacgatgagaagagtccagtagaaaggaaaatattgctgatgttgcagagaggataggctggctggagtgacaccctggagcagtaagagatgatgggatccagcagtccagtgcaggattctttgggtggacctagcagttgttcatccacagtcacagggaggcaataagaggcggatgggtggaggtggacgtgggagtctgtggaagacttttaccacttctattctcttagcaaagcaggaggcaaggaagggagaggcagtgggaaggattgaacagagaggaggaagtgcgaaatactcacttggaacaatgggagattgaatagaccaggcaaagaatgattaaagtgaggacggctggcatggtcctgttttcctccagccatgtttagttgcatcgtcgtggcatggaatagatggagagctgggtttatccagggctcccatcttaccaagcagataggagatgacagggaggtgcatgagttgaggaggtgtgcaagggatcaatgagaatggttggccattgagtttaagctggctcactagagagggtcataaaggaagaaacagtgaacaagtagtaagatcttgattggaggtgctggtaaggttgcaggagttttgtttcagggcagtatagggagtgacctggacagataggaggatagatagacctggtcagagtgggatactgtgggggttgcagtccttggacctgacaaggtctaaggtctgatcatggagggagggggaagctgaggtagggcagaggacaggagtgggcttcatgagaccaaaaggatgttggaaggattatctacctggatactgaaatcttcaagaagtaagaggtgtagtgtgaagaagttacaacactctaagctcttcagggataagggaagcatgtgccacgtgggtagcctcccaagtccagcacccagtatctagaatatgcagagtgaatacctgggggctgctgagggcaagaacaaggtgcctgtgagaagacctgacgcctggggttctcgtgacaggagtgggcctagtttttggtgtagaattgagccttgaatgcaccagcgggatcatattgaaaagaaaccctccaagactaaaggaagatgcatcctctgacaatgtacgctctgtaggctcccaagtagctgggctggggattagatggactccaaggcatttcctcaggtggcaatgggcggatccctgggaaggtaaagctgtgcagtaagaaaacggcaagatgctacgttcactcaggtaaagcccctttcccgggtttagggagggcgaggcagtttaggctgggtcagtttgtccctgccctcacggtttgttggtcctggcaaaagagggccttatgttatttatttttcttagagacagtgtcttgctctgttgcccaggctgaagtccagtggctcatctcagttcactgcagactccgcctcctgggatcaagcgatcctcccacctcagcctccagagtagctgggaccacaagcaccacaggcgcccggcacgatgccggctaattttttttttttttttttttaagagagagaggtaggctccctatgttgcccaggcttgtcttgaattcctgggctcaagcaatcctccctcctcggcttcccaaagtgtagggattacaggcgtgagccactgcgccctgccaaaagagggctttagggcaccccagaacgcgagatccccctcatctgtaatctttaaagaggaggaagtgtactccaaatcaagcgatagtccatccgtccttggcacggtgactgccgggaggccaggaccaaatgtgtctccttccggcttttgcaccacactaactaaccggcgccaggccgcagagccgccctggccttcggcgagaactcaggcgagcgcggcgcacgctgctccggagtcccaccgcggaagttgaggccgcggattccgagggcggggtggagaggaatctggaaggacctggacccggtggaacgcactgcgcggacggcgcctgcgtccgcactcagctgttcagccctctttcttcaggctctcccctgaaagccgtccccatgccggtctcttttttctgccttcttgtttccctccggcgagtcagcgcgactgtgaatttccgtttccggcggtgtccatgctgacctgaggagtcgcggctgcgagcaggttcggtgctgcgggttggggtaggcggcggtggggtccctggttctggggcactgggaagatcgcgagtcgtgcgtgtgggaaggtcctcccccggtcctccgggtcatctttgctcccgaggagcggcatatttctcatctggcggaggtgtcctggggtagttgggtgagtgacgtgatgaatccctgcagagagcccagacggggagggaaggtggctgggcgacgtcgtttcctggcgacgtggtcccggtaggagacttagacctgagctggatctgttgaccccaaattgtgcttttcccaccaagaagaaagacagggagagaaacattagtacaagtgctgaactaaaatatagcagagaagaaacataatctctgaaatcacacagctattcggtttcaaagcgttcctagcgcccagctctcctaactcctggccagtgttcttgacattatggtaatacataaagactttgtttccgctggtgtgtgtctgtgggaagcctctgactcacctccgtgctccagtagcaccctgtgcagccttccaatgtcgcccttattgcgtggcgcggaagataatagtttggatttcctctgcaagtcagataatagctgtatccacttactggcacagtgcctagcacatcgtagacagacacaaatatttattcaacggaatgaatacagtaccttaattgaatgaaatggcatcctgctccgctttttttttttaatcaagctgtcagattttatgcagcccgatttcctaaaataactcactaattcagtgattgccaatttattagccacagattcccaggtaactcagaaatcactggaagggtctctgtaagttcatggggtctccaggtgtcatctagaaccagtcctatctcacacgtacagctatttctatttttcaaatgtatgtagataagttgtaatttaggagttttacagagtcaacaggtactaaaagtaatactgcgatcatattggaggttcataaaaacgtttcacatttttttattaaaatttaagttttagtttaagttaggaaaccacttcatcagtccagttgatacctgggtctgagctgtccagtatggtagccacatgtgactatttggagttagaatgaaattaattaaaaactcattttttcagtttccctaagtatattgtaagtaaccacatgtggctaatggctaaatggctgaaaagtacagatatagtatatttctatccttgcagaaatagatactgctgatgttgacacttaagatgaataaaaagtaacttaaccataaaatgtaatcttaagagaggtaactcatctaatttatagcataacagagagaaatgaaattggggatggttaagcagtttctacccttgttcagtgaacaaatacatcatctcttcataaagaaataaatgaaatttactgtttttccctgggtattgcctggattgtaaaatgcttctcccatctccttaccccaaccttcttccttgtaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggtatgttaggctacggtctggtcattcttccattgattctttttttaaatagtaggagcctctcacaggtgacatttggattcacgagtctagtccagctccaaaggacatggagattcatggtgtgtggctttcactaaaacgtgagaagcttttcccatagaagctgccttgcctccagcatctgcatactggttagtgtttattgcccaggatacaagaatttatagactttgtttgttcctaaattttaaactgtttctatggtgataagtgtgctttttccccccaggtatgttttacatagttgtaatataaaatacaaaaattacaatatttaatactaacatagctttatttagtgagcccttgtgatatgcctagcagtgtactttaaacattattcaactaaatccttccagcagccttaccagagtaggaatcattcttgccctcattttatgggtaagaaaactgagatcaagaaaacaagttacctccaatcatataaccagtaagtaggagagctaaatgtaactccagcgcctctgctcttatctgctatgatgtactgcctcgctatttaccttttggttttttaaaaaactattaaaatcactcttaaaacagtcagatttaaggagtgtttaattttcgctctctatagtattgaagtcatcttgttacatctttattgaacagcaattatttggatggggccagaagttagcaagttaataattgacaagttaattatatttatatattgtctgttgtactctctataaaatgtgctaaagtactcatagctataagtgtaccaaaaaagtctacttataaggttgataccttttactctattttgaaaatgagtttactatttatttatttgtttattttttaatgaataggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaggagatgccaccacagacacagagttggcgtggctgttgtcatctgagggacatgcatgcgtttgttgttttcttgagtggaacatgttaaatattgtcatatcatgggacttctcttatacttagtattactaagttggctatagcttcagaaaagggtaagttcccagagataaggatgtgataatgttcacatttcctcccagcactctgggaggttccaaggcaggaagatactcgaacccagcactcgggctggaaaatcaagctttgctgctcgattgcgacaccagccacagtcctcttcctccgtgtagaaggatgtgtggtccagcctcttaaggtgatgctttccttttcttcctggtttcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatattttcttttcccttttttgagacagagtcttactctgtggtacaggctggagtgcagtggtgtgattacggctcactgcagcctctacctcccaggttcaagcattcctcctaccttagcctcctgagtagtgtatgccaccacgcctggctaatttttcttttttttccttttttttttttttctgtagagatggggtttccccatatggcccaggctggtctcaaaactcctgggctcaagggatccgcctgccttggcctcccaagttgctgggactacaggcgagagctactgtgcccagcccatattttcttgactgttttatttttaccttaatttagaagtaattattgttatgaatattctgttgcattatgtttgaggatgtttgtagctctagtgggaatacgggaagttttgatagaggcaaagacattgggcctgcagctgaacagcaggatcatggttatcatggagtctgtgcagtcagaattttccctttttgagcacttttattcatctgggtagacttttgatgttatttaaatttagaacacagcaagaaaaacagaatggaatttattttattttatcagtttttgcctgtaaaaatgaacttcttgtatgctcctgtaaatgtatatgatgttttactggatgcagttaaaaaatgaaaattaagagttgatggttagagttttttcagggtctttttaaagtaaaattttcatcttttcacttataggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatatgtatacatatatacgtacaaatatatcatagtaagtaccatttcttcttggactcttcctggcactgtgctaactgctttctacaaatttagcttacataaacccttgatacacccttgaggtgagtaggtattatctgtagtttacataagatgaaatagagcctgccagcagttaagtaacttgtgtgaagttgggacccttgttcctgatggttccagaaccttcatccttaatgataatgctgaagtaagtacatgaattgccctgaagaagtggtcagtttatcaataaaaagtctagacagtcctcagtgtatggaaaatgtaaatgctcttgcatttatggaaatgatagtgttcactattctgatagtctattaactatcttttaaattagcaaaaataaaatacaaattagcaaaaaaataagccatattgattaggaagtgtggggtgacagacaccttgattttttcatttttatttagttttttctagacacctgtttggtgacaaagagctacagattttatactttggcccaggaagactcctaaaatataaagtaaaaagtaatacagattttaaagttgtgccattgtaatgtcagaaaactaaataacattcaaattttgaacatgtaatgttaatattagtaaaaataagtgttattattaacgtagtgtaagcttactaaatcttgtatacttgaaatgattgaaatagttcatagaagtcatttgtttctcttttatttaaaatgtagcaagcttctaattttaaagacatacatattaagagatacctttacttttttttatttttaattattatggatacataatagttatacatatttatggggtacatgtggtattttgacagaagcatacaatgtgtgatgatcaaatcagggtaattaggatatccatcacctcaaacatttatcatttttttgtgttaggaacatttcaatttcattcttatagttattctgaattatataataaattatagtcaccctattgtgctgttgaacaccagaatttattctaactgtatttttgtacctgttaacctttccctctttgtccctccctccctgctccccttcccagcctcttaaccatcattgagagagatgcccattatgtaaatcttttaaagatttttcaaaaggaacacacacatttggtaaagtactctaactgtaatgcagggtgcacacaatgtgcattttctttttccttagtataaccgctggtctctcagatccctgcagagcagtatccttttagatacatataaacacacatgccaccctttaaaaacaaatggtagcttattttacacactgttctatgctttgcttttttcatataatgtattttggaggtatataatcagtaagtactgcagctctgtctcctttttaatataatattccattctatggaggcaccataatttatttagcctagcttatgttgactgctctgctgtgggttgccaaagcctcctgtgtacagcaaaggcacacacagtacgtggatttgggtgtgtacaggcgtgtgtagattaggggaataacactggcttagatgacaaagactggcagctgagggactgtttgctccctgttcttcctgaccctacaatcagctgcttgccccctggcactctgtggcatcaaatgtagtgtgaggatattccgcctgtcctttgagctggtccagtgttgctgaaaagctgtgcttgctgcctcagtccacagtagcagctgtgctttctcacaagcccaccttcatatattctgtggtttcggattttgaatgtttcctagtttaatcaaagatgggcatttctgtttccattttttttgttatttttagttatctatgcaaagataagaacagaaatgtttttaatacttaaactagaaatttccaggaatcaattctgaaattattttgcatctttgaagcatcttaaattttaaaaattggtctcatctgcttatattttcttatagactaccattcatcgtaatcttactgtttttttttttacctaattctaaactggtagctatttaaaaaaaatttctgagcaattgagttatccaaattaacatataagatagaggtttccactgcatacttctcaacaaaaaacagattgtggtttttttttctatgaggcgattgaaagaagaggttggttttctgtacatatttaatgtatttcattgattatgactctcttcccattctttggatgccagagacctgttatttggcttaaaaataccttacagaaaacttgatttctttaaattaggatttcttaggtaagggccaggttagacccagccttttctgagttacttctcatacattaaaattcttataatggaagtttatatcctagtggacattgtcttatgggttggcttttagagcaagtcagagggtggtggtttctctgtctgggtgatgcctgtgtagtcatttgatttagtctggagtgcaacttttccgtccagggccaggtagtagatatttttggctttgtggatcatatcttctgcagctacttagctctgcagttgtagtgcacaggcagccatagacaatatgtaaatgaattaatgtggctatgttccaataaaactttagttacaaacacaggtgatgggctggattttgcccgtggccagttgccaacccttagtgtaggtggtctgttttggtagtttctttgagaaattatgtgttctgcttttaggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccggtacgaagagaaataattgttggatactaacagtataatccttttaaaatagactgaagaggccgggtgcagtggctaacacctgtaatcccagcactttgcaaggcagaggcggtcggatcacttgagcctagagttttgagctcagggcaacatgaccaaaccccatctgtactaaaaatgcaaaaattagtccggtgtggtggcgtgcgcctgtaatcccagctactcaggaggctgagaagtgagaattgcttgaacctaggaggcagagggtgcagtgagctgagatcacgccactgcactccagcctgggtgacacagtgagacgcttgtctcaaaaaaaaaaaatactaaagagacattactaaacgtctctctaggattcgcctcctgaatttcctttgtgtgtgtattcacagtccctggcctcctgaattcctttgtgtgtgtgttcacagtctatggactgctgaattcctttgtgtatgtgttcagcctctggcctgctgaattcttttgtgtgtgtgttcacagtctctggcctgctgaattcctttgtgtgtgtgttcacagtctctggcctgctgaattccctttgtgtatgtgttcagtctttggcctgctgaattcctttgtgtgtgtgttcagttttctggaaggtttccctcaaaagagtgcttgtttggggcctcttggtgtatctcatttgtctctctctgtacctgctgcaccaggcagtgtctggctgttttggggtcaggacttaatagagtacctcggaagtttctcccagttacaggaccaggcactgccccttcctttctatactgctctggaccattggccacagaaccgtttctgtgctcagacgcctcacctccctctcctcaccatacttagatggatgccccggctcggctgcagagcagtctgcctctgtggggttctaataaatcctgaaagaagccagcaaggctctggaagcctcaggacagtggctttgctggaagtctcccttcttaggattgcttcttgtttagagcttttattttgttgcagtattgatgataatttaattgaaatttaatttttaattttcctctaatgtttagggtgccaagctgttctacctttctggaatggtgcatggagaatatcaaaaccaagaaatccacaatctgggccgttttattacagttatgaagtttaggcctctcacatggcaaacttctcacccttatatcctggcagacaggtaaaatatgattttaagctttttcttcctgggccatatatttcaaagctaaaaaggctagaaaaagaacagtgataggatttattttgtgccgatttgaataggggggatagaagtgtagttgatggaaaatgtctacttatatcattgctcaaagatgccgtgcctttgggagtaaattaattatgagatgttaaggaaaatgggagaacttggaagtatttaaggctacaggatgtggccccatcctacgttcagcctcagttttcagtgatgctgccttcatgcccgggtgcttgagtccttcgtgtgtgccttctgtttccttcctttgtgctcttcctcgtgtggttttctcagcctggaattccctttttccacctgccagaatccaagccacagtaaaaatcccagagcacaggctcgccctcttccagaaagggattttctgaatatgttcttcactcttccccgaccccaggtggacgtcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggatggaagatttgacaaacccagaggatatccgaacaaacatcaaatgtgaccggaaggtgtcactttatggttatttaagaggagcacacttgaaaaataaaagccaaattcacatgccaggtattctcttgttgtagaacatactagaattacacataggattcttgggatggcttcatttctcaggaaaactgaaaaatgaccaaacaagggaagatggccttgctggaggttttaaaagtaagccacctatgtgtaggcctgcaaaggtgttactgaatcccctcttctctgacctcttgtcttgtagctagggggccactgttccagtgtggcacaatgcccttctttagtgttatgggttaagcccttggactgtggatcatatttaaccccctagtcaatggtagatgcttctgacttcttgtcagctgaagctggcttttgggttctgtcttccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggtatcggtgagacgggagtcatttctctgaactttcagtattctttctgaatctattttttaatcacaaaaagtaatgtactcagcttttatttattgaagatttttctcttgtacttataataaaggcccaaatgcatattgtaaatatataggataaaaataatactttttttttcattgtaccaagcagaagagtcctctccttcattcctccttgatccatggccccagcacaggcattgctgctgtgtggcgcctgcacggcccatccccgtttctacaaaatcagtgtgctttccagctttcattggtctttttctcattcacaatggtctcctcatgctgtattttaaagtggatttcaaatatttatttctttgttctgaagtggaattttattgggttaaaatcggcttattttaaaatattagaaaagctagcattgttgtagctttggagctgaggtttttctagctaggttgtttaggttatcaggttatatactccctgaactttggaaaagtttaatggagatggggatccatttcaagctttgttgtaaggattttcttctctgctttttgaggcattaagaaaggttcttaggaaatgtgtctaagataattttgagaaactgagtgaagctcgtgtctctccaggatctttgtgctttcctcacgtgccctttcttggtggtcttgacaggatgaagtggggcccacccatgagctggtccagagtctcatctctacccactccaccattgatgccaagatggcttcaagtcgagtgacgctgttttctgattccaagccacttgggtcagaggatatagataatcaagggtaagtctgctttttttctatttttaataaaaagatgtattacaaaagatcatatcacccataattcagccatcataacacatttcggtgggattcattctatgttgttttgtttttctttgtgtgtgcatgtgtctctgagggctcttcacttacctgacattacaagggagtcttttcttgaaataaattgcaggatgcatttttcaacagaccccaaatattcctcaaataccatgccatcttccataggttgccttttgttttttaagagacctgaagccacttggctttcttttggtggccaaaacactagagcaaagtcagggagtttgtggctgtccagaagccacatgccttgtctctgaaagttttatttagattgtgttgtattatctcctctgggtaggtttccgtggatgtatggctcatgtgaattattttccagtctgggttggggatttgtatacctttatatgcagtggatgtttgcaaaacattggttttgttgtattgatttatgactcccagtaaaatttatctgaaaattttgagattatctagtatgtaatttggtacaatgtgcataaactacctagcagaatgcctgacaggtacgaagtgttcgccgaaagatcactcctttataatgggattactagctattttcacttttgcatatccttctagtcatctttgtctacaagaatactctcctctaatatagttacagttaaaatacataattttatttctatattatcatttccttctttttttttttattatactttaagttttagggtacatgtgcacaatgtgcaggttagttacatatgtatacatgtgccatgctggtgcgctgcacccactaacttgtcatctagcattaggtatatctcccaatgctatccctccccgctctgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgcggcaataaacatacgtttgcatgtgtctttatagcagcatgatttatagtcctttgtcatttccttcttctatacagtctttatgtagtcatcattttgttattattggtgtattcttttttttttgtgacaagatcttgctttgtctcccaggctggagtgcagtggtatgatcttggctcacttcagccttgaactcccaggctcaagtggtcctcctgcttcagccccccaagtagctgggactacaggagtgcgccaccactcctagctaatttttttttttttttctagagattaggtctcaccatgttgcccaggctggtctcaaactcctgggctcaagcaatcctcctgccttggcctcccaaagttctgggattacagatgtgagccactacccctggcctattattgctgtattctaacttacccgtctcttatggtatgattttcagttttttcaaatttatgttttcttaattttatatatcttgctacattaaatagcttcatacagttttcttttatcctgtgattttagcttcctgatgattcttctgtatcagttatagcactggtgacttaaaatggatgttcttcctctgtcattcctcctacgtttgttagctggcatttttaacaaagagctttctcttctcccctttatttcggtatcactgctgactaatgcacttgtgttttgttccatgggttattttccatcactatcattattcttcctgatgcctatgctggcccagatttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtaagcttaaatgtagttggttgctgctatgaacttggctctcgaaatggtaaccaaaggaatgtctacatttaggggtctgttgattctgtgattttgttaactgttgaaaagctgcattgtggatggatctcaagggaggggagacacatgaataagcctaactggaggttggcattggtcgtttcaggtgccctcaagtggaaggaagacctttccagaaaggcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaataccgtccattgcatcatgttatgtcccctatttaaaagtccttcatgagaatttttttgtagattagtgccagaaaaatattcctgcccataaaaatatttatttttttcctttctgagaatgagaaccctgtataacacattttgttctcccttttgcccttgtcctctgattttatgctttactaaacttaccaatatgttctttctggtagaattaatgcaaaaataaatatatagtggtgaactttacattgtgctccctggttactgcatggtgagatcaaggccacatggtgagacatttgggctcagcccactgaattgggaaggttgttgtatactgattttcattcaggttttgtctaggtactcttagtgatgagaggctcaacactctttagagctcttctttaataatctaaagctctgcctttaaattcccttccctcccttcaccgctaatattctcactcctcggcctcttagctgctcccgtgcaggagcacaggagccccacacatgtagagcaatagcttcctggctctcttcatctgtggctgccctgccctctcaatgcctaactcttatgtggccattgccatacccaccacagacagagtccctcagttcctgagttcaaagactcatggcctaactggttgaaaatgatgagtcctctagggctgtaatttttgttctcacttttctgccatggtgtgctctttagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggtaagtctgggtagtacatttgatttattagagaattagcgaattgttctagaataagattatctgatgtcaatattgcttacctgttgttggcttcttatttttacaggattacaggtcattctcccagatattgtagtgggcgcttcatgcatcctaagcagtaacatgttctgagtttagttagaccatgtacatggcccacagaggacaggttcagctttcagtgtggacagtagtgtgcatctttattttgaaacatcacacataagtttttatacatcagatgtattttgtgtcttatcactaggatatatgtagcatccctgagttaacatttatagtttctgctatttgtaagcatagagaaatctgtgatacctgtatatgttcttcctgcagcttaccattttgtagtcacactggaattcattcagtactcaaactcaccacagcttaccctcctcttagacctcttctctttctctctctctctctttaagatatggtctttctctgcagcccaggctggagtgtagtggcacaagtgtatggctcaatgcagccacgacctcctgggctcaagggatcctcccacctcagcctccagagtagctgggactataggcacgagccaccaggcctggctaatttttgcattttttgtagagataatgtttcaccatgttgagctagtttcgaactctgggttcgaatgatcttcctgccttggaacttcccagagtgctgggattacaggagtgagccatcgcgccagcccctttctctctattctcttctggaatgttctgattttccaaaggctgctttctttttgtcaattcagtttggcttagatgtcacttctcacagaggcccaattgctatcatactgtctattgtaattcgccagataacacttaatgtactttatgagattttatttaaccatttttttatggtgaaatttaatacagatatataaaaccacgtaaaaacaattgttcagcctaatgggttgccagaaggtgaatatccctgtactcagcactcaggctgggaaatcaagctttgctgctcaattgtgacaccagccacagtccccttcctccctgtagaaggaggtgtagtccagcctcttaaggtgatgctttccttttcttcctggtttcctcctccatgcttccataagcatcatagtttacttttacttggtcttcattactgtttttcagtctatcttttaacatttttagtcaacagtctttccttcccatttctttctttggttacattttatttaataaaccaagtctttggtctgtagagtttcttgtattctggattttgtggattgctttgcatccctctggagtttcccaggccctcctgtatttcctgtgaatgggtatggagcaataccaatagaacttctgtaatgaaaggaatgtatatctgagctgtgggttgtggctacttgtggctactgagctctttaaatgtggctaatgagactggagaactaaattttaaatgttatttaatcttaattaagattaatttaaatagtcacatatttctagttaccctgtagacaaaacatctagcagttggatgggatttaaatttgatttttatttttcggcgaaactgcttcccaggtgatggtgttttctcattaggaggcgcataaagactggttgtgtccttttaatgctgttagatgttatcagttgttggtgctcaatgcctagaaccataccaatttcttaagaatgtagagtggtgatgttccattcaatcatttctctttatgtattagctgtaacacttctttaaagagaaacttttcctcttctattcggttatccactgccatatatatagggtaaatgcttgatttttttttttttttttttgagatggagtttcgctctgtcgcccaggctggagtgcagtggcacaatctcagctcactgcaagctctgcctcccgggttcatgccattctcctgcctcagcctcccgagtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattctggatataagtcccttatcaggtacataatttgcagatatcttctcccatgttataggaattcagttttcaaacaggtttagattaacaaatagcaagaccaactttgtaaactactgtctcattgcattgccttagaaaccttaataaaattgaaaatcagttgaattagtaattatctgtttgtttacttatgaggtcagtagagtagtagtatttaatactttccctgtctgctgcttaatgtgttttatctctgtggttatactgtctccatcaaaggtaaagttattttctgggctcatttggaatgagaatatccatgaaagtgggaaatatttaaaggcaagttgtcacctactgccatttcttagagttgttttgctgagtgattggaacacctcacctaagtgctgacttttctgcgtaaggttatgaacagtatcagagattgcttcgtgactggaaagtgggaagatgataaagatgcagccaaggtcttagcagaagatggtaagtaaagagctgggttcttcaggaagactggcttctctaaactttattttcttcagtatcttagacaatagtcaaattgaaaataatagtcacttgtcaaatgctttgggaattcagacaggagtaatgaaccaggtaatattctgggttttccttttatgatgatcttattttctcagttggctgatttactgcgtatggactttaaaagtgagaaactttccataaattttaatcatgtgtttgttaaaaatagattttgtgtgatgtgaaaaatatatacaaataacatttatatttttttcataataaaggtagtatgcattgtggaaaatttcgaatgaaaagtacataacataccagaattctaccaacccataaaaaaacctttgttagcttcttcaactgtttccttctagtcatttaaaaattgtgtgtttaaacctttttagttgtactttatataatttttggcaggaggattgcttaagtgatgtactttttataaattttgtcattaaattttttcaaatatttcatttttattatttaaaattaaaaaatattttatttaaaataaataaaatattatttattattatcataccattattgaagtcacaattttttcaatatctaagtagttttatactttgttcattttataaagaactccacactgaacaactttgaaataattcttggctcacacttttttattttcataagacagattcataagtgttagaattgagtcatttttatggattgcaactgccacatggttttttggaaggtcattctttttgttttgtcttgagacaggatgtcgctctgttacccagactggagtgctatggtgtggtcatggcccactgcagcctcaacctcgcagactgaagcctcccgagtagctaggaccacaggcttgcatcactacacccagctaattttaaaatttttttgtacagacagtctttttatgtttcccaggctggtctcaaactcctaggcttaagagatactcctgcctcagcctcctgagtagcttgaaccacaaatgtataccaccatgcctggctaatttttaaatattttgtacagatgggggtcttgccatgttgcctagctggccttgaattcctgggcttaagcaatcttcccgccttagccttccaaagtgctgggattacaggcatgagccactgtgcctagtctgtagtatgtgaatgtattctttatatatatataatttttttttctgggccttctagttaatatcactgatctctgttggttcatttattattactataatttagtactctatgcagctttatcacgttactaagataccagttattaaaaccgtgtctcaacagtttccctttttgttctgctggggggcttcttttaggattctcctgactattctcaccttctcacttgcttattgttttttccataggaacttaagaatcggcttttctgttttcaaaagaaagtgtggtgggtttcttttttaatcacttcagtgaggtataattgatggtaaactacagtatttaaagtatacaatttgataagctttgatatgtgaatataccatcaccacaatcaaaataatgaacacatttgtcacccccacagttttcttacaccactttgtaactctccatcttgtcctcttccatcaccaggtacattcagctgccttgtgtcactattcagtaggttgtgccctttagaatttaattgaaatgggatcctacaatatgtactcttttctgtctaacttcttttactcagcatgattatttcaagattcatccatgctgttgcatcttcatttctttttgttggctagtgggtagtccattgtatgatgtatagcaatttatttatctgttaacctgttgataaacaattatttccaggttttggctattatgagtaaagctgctatgaatgttttttagaagtctttatgtgaaccaccgcttttatttcttttgggtaaataagtagttcagaatggactaaatgggtcatatgataggtacacatttaattttttaagaaattacccaactgttttccaaagtgtttataccattttccattgccaccataactttatgcaacttccggttgcttcactctacatctttcccagtacctgatagtatcagtctttttaaattgtaggccttcttttaggcatagagtggtatcttgtagttttagtgactaatggtatcgaacattttttcatgtgcttatttgccgtctgtgtcttctttgatgaaatatctgtccaaatcttttgtacattattttaattttgttgaattctaagaaattttgtgtatttttgatacaaattctgtatcacatgtgttatccaattatttttgcctagcgtgtgccttgtcttttctatttttaatagtgtttttcacagagcaaagtatttagttctggtgtaggtcaatttatcaaaaaaaaatttttttttttttgggatggagtcttgctctgtctcccagagtgcgatgtgatctcggctcactgcaacccctgccccctgggttcaagccattctcctgcctcagcctcctgagtaactgggattacaggcgcccgccaccacgcctgcctaatttttgtgtttttagtagagatggggtttcgccatgttggtcaggctggtcttgaactcctgacctcaggtgatccatccgcctcagcctcccaaagtgctgggattacaggcatgagccactgtgccctgcccaaaattttctcttatggactgtgcttttcatagtgcatgtaagaaatctttgcctcacccaatgtcacaaattgtctcatatattctgtaagtcttacagtttcaggttttacgtttaggtctataattctttttgagttaattttttatagagtgttgggtatggatttaggttccttttgacatattgatatctacttttccctgcaccatctgctgaaaatctatttttttccccgttgaattgccctgtattggttggccatatatgggtgaatatttctgggctctctgttctgttccattgatatatttgtttatttttgtaccaataccaacactgtctctgttacttacagctttataattagtcttggaattaagtagtttttaactttaggtagtttttcaaactttagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctcactgcagcctctgccttccaggttcaagcaattctcatgccccagcctcgtgagtagctgagattacaggcagccattatcacgcctggctagtttttttatttttagtagaaatggggtttcaccaggttggccaggctagtctcaaactcctgacctcaagtgtgtgtttggaggggaggggtaaactttgactaaacagtattcatggttttctaagtaaatacttcttactatcccaaggattctttttcttttatgctgctttttctcctgttctgcacaataaagcctgggcttccaattctgctttgacctttcaccttggtccaatctcatatggttcccccagtttctgtgcaggatggttctgggagccaagcaggaaactatctacagaaaggctgagatagatcccagtggttttactttctttctttcctatctggatgacttaatttttcttgccttactgccctggtttaaacttccaggacagtgtggattagaagtcaaagtaaacaaccttgctttgtcctgattttgcttattttccaagtgaacttaagaatcacctttctggctgggcacagtggctgacgcctataatcctagcactttgggaggctgaggcgggcggatcacgaggtcaggagtttgagaccagcctggccaacatggtgaaaccccgtctctactaaaaatacaaaaattagccaagcgtggtggcacacgcccgtaatcctagctactcaggaggctgaggcaggagaattgcttgaacccggaaggcagaggttgcagtaagctgagatcgcgccactgtactccagcctgggcgacagcacgagactccgtctcaggaaaaaaaaaaaaaaaaaaaaaatcaccttttctatttccaaaagaaaagtttgtggtgtgttttttcctaattaaacttttaagtttgaggtaattgtagattgacatgcacgtgtaagaacaaatacagagaaaaaaaaagaacgaatacagagagatctcctgtatcttgtactatagcagtatctgtgtatatatgtactatgtatactatgtgtactgtaatacaaggtcacagcctggatgccaacattgatacaatctgttgatcctatgtagatttctccagtttcacttatgtgtgtgtgtgtgtgttttacgtgtgtgtgtgtctatacttctgtgctcttttatcacatgtgtaggtttgtgtgtctaccaacagttaagatacggagcagttccatcacaaggattgcttgtattgctgttttataaacacacccacgtccctgctgttccccagcccccagttccttcccttgtgaaccataatgtgttttctgtttctacaattttgtcatcttcaagaatgttaaataaacagaatcatacagtctataaacttttgtgaggggcttttttcactcagcataatttcctggagatccattcaagttggtgcatataccataggtcattcctttttattgctgagtagtgctccattgtatggatgtaccggtttgtttaaccattcatccaagatcaagctgggttgtttacagtttgttttgttttgttttgttttcagacagggtcttgctctgatgcccagtctggggtgcagtggtgtgatattggctcactgcagcctcgacctcctaggctcaagtgatcttcccacatcagcacccccaaggagctgggactacaggcatgcaccaccgtgcctggctaatatttttttatttgtttgtttgtttgttttgtagagacaggatcttgctgtgttgctcaggctgatcttgaactcctggcctgttttcaatttttgactattagaattgagctactatgaacacttgtatagaagtttttgtgtaaatatgcacttcccatttttctgggaaataaatgcccaataatgcaattgctgggtcatatggtaattgcacagtttcataggagactgccagagtagttgggccatttgatgtttctactagcaattatgtgagtgatccagtttctttacatccttgacaatgtgtggtgttctcactgttgtttattctagctattctaataggtatgtgatatttcattgtggttttaagatatacttccccagtggctaataatggtgagcattttttcatgtgtttatttgcatttttatatcttctatacagataaaaaatgtctggggatgtcttttttttgcacttttaaaaattgggttgggttgggtactgtgagttcattatatgtttaactccatcgtcggatgtgtgatttgcagatactttctcctaatctgtagttttcattttcttaacggggcctttcacagagcagaagtttttattttttatttatttatttatttatttattattattattatttgttttttgagacagagtctctctctgttgcccaggctggagtgcagtggcgcgatctccactcactgcaagctctgtcccccgggttcatgccattctcctgcctcagcctcccgagtagctgggactacaggcgcccaccaccacatccggctaatttttttgtatttttagtagagacggggtttcacagtgtttgccaggatggtctccatctcctgacctcgtgatccgccttacttggcctcccaaagtgctgggattacaggcgtgagccaccgtgtcgggccaaaagtttttatttttgatgaaatccgatttaccagttttttatagtattttttgttttctctttacacccatgatctattttgattttttcattttatgagatatgaggcttagctcaaggtttatattttcgcctgcaattgtataatttttctagcaccacttattttattgaattgcttttgacttttgtaaaacattagttgagcatctttctgtgaatctgtttctgggttctcttgtgttctattgacttcacatgtcaatcccttggccagtaccacccttgctgtctacgttcctgtagctttatagtgagtgttaatgttgagtagagtgactcctcttactttattcttgtttttcaagattggttaagctatcccaaggcttgtgactttccctataaattttagaataaacttgtttatgtctacaacaacttacctgggattttggtagggattgcattaaacctatagatcagtttggggggataatctttttctattttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtttcattctttactcttttgatatagattacactgatccttttattttttgagacatggtcttcctctgtcacccaggctggagtgcagtggtgcgatcatggctcaccacagcatcgacctcctatgctccagtgatcctcctgcctccacctcccacgtagctgggactacaagtgtgtgctatcatgtctggctaattttttttttttttttttttttgtagagccaggtcttactgtgttgcccaggctggtcttggcttcaagggaactcttggcttcaagggatcctcccacttcagcctcccaagcgttaggtttacaggcaggagccaccgcacctggcctgattcattttttgaatgttgaagcagacttgcatacctggaataactctcacttgatcatgaatgaaaatgaaaatacaacatatggaaatgtgtgtgtttttttgttttgttttttcctttcatgtcagatggttaatgtgctaatgttgtaacaagggtcaagggtggcatatcccacatacatgcatgaatacccagtcatcacacttatgaactacgaaaagatcaccatgtgaaaatttttatacaaatctttttatgtgttgttggattccatttatagtactttgttgaggactttttgcattcatgagagatactggtctgtgagtttttttgttttgttttgttttttctttttgtggtggtactgtcttcatctggttttggcattgggataatactagcctcataaaatgagttgcaaagtgtcccctattctgttttctggaagagtttgtatagaattgggatgaattctttaaatatttggtgtaattctccagtgaaatcatctgggcctggagatttcttattccagaagctcttaattacaaattttatttctttaatggttataggacgattcagattatctatttcatcttgcctgaattttggtagtttatgattttcaaggtgtttcaagtcttgttagggaagtggaagttgcactgagtgccttcttgaagagaccagcttgggtagtctgagggtgatgtttagagtatttgcttaatactctttaacggctgcaggagcctttttgataacccctgttttattcgtgatgttgttggtttgtgtcttctctgtttttatctttgtcgtaaaatttattaattttgttgattctattcaaatgaccagctttttgtttcattgattttctctgtttttctgctttcaatgttattgatttctgccctttatttattattattattttttttttgagactgagtttcactcttcttgcccaggctggagtgcagtggcacgttcttggctccccgcaacctccacctccgggttcaagtgattctcctgcctcagcttcccaagtagctgggattacaggcatgcacccccacgcacagctaattttttgtatttttagtagagacagggtttctccctgttggtcaggctgttctcaagctcccaacctcagttgatccacctgccttggcctcccaaagtgctgggaatacaggcatgagccaccacatccggccaatttctgccccttattatttctattcttctgcttgtttggggtttattttgttctttttgaaatttcttaggttattggtttatcttttctcatttctaatgtgagcatttagtgtttaaatttccttctcagtactgctgagctgtaccccacaaatgttcacgtgttgtattttctttttcttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcacgtgttgtattttcattcatatttcctttgggacttctttttggcccatgcattatttataaatatgttgttttaattatcaagtatttagagagtttcctgtttttctgttatagatttctagcttgattatattatgttctgagaacatattcttatgagttgaattattttagatttgctgtgatttcttttattgccccaaatgtacttcatcttggtagatttctattgactttaaaaatgtgtgtattttgctgttggagagtagggtgttatacggatgtcagattttgctggctcactgttcagatcttttgtaaatccttgctccttttctgcctagtttcactctgtcacttacgctagagtgcggtggcatgaacatgactcactgcagccttgacctcctaggctcaagcagttatcctggcttaacctcctgaatagctggtactataggtgtgtgccgccacacttggctaaattcaaaattttttggagagacaaagccttgctatgttgcccaggctggaactcctggcctcaagctatcctttgtctttgcctcccagagtgctgggattacaggcatgagccactgtgcccggcctccgcctagttttaacagttgctgagaggagggtgttgaagtagatgtcttcttggtgggttaatccttttgtcattaagcagatgttacggtcacttccttttcaccccattggtgaaggaggggtccctgccctaaagtgtaggagatggctgaacacgacacctggcgtggatggatgagactgacagcagtgttttagtcacatatacccacagctcagaggaggacactgcatgccacgcagggtcagatgggcaccatactctgtagtggagtgagggctgggggctgaggaaggaggcaggcttggtagtaacaagagcacacaatgaccaatggttcctgagggggaatgcaattggcttgtttgaataaattcatgggctggcagacaggtgaagtgaaacttcttaggctgaggtgcaaccgttctggctgataaaagaactagccaggtggggagcctttgctgctgggtggcggggtagggggtgtctggtagaaacaggaaaacccacggctaggcctttggggccctgtgaggctcaaagatgtccaggcagcataggaaattttagatcttaaaattcagcgaagaccctctccagctctggtaaattattttgcttgaagtctacttcatgagatattaatatattcactcctgcttccttaaaaaattaatgattacataggatatctttctccattcttttactttcagcctacttaggtccttaagtgagtttgaagtttcttatgaacagtatttagttgggccatgtgtttattataggctctccatccatccgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttgaagtgtttgctctggatgttacaatatgcatattgtaatatagtagtctactggtaccagtatttaccacttcaaagtgtggaaacctgccttgcatttatgtctctttaccttttccgcttgtatgaatcactggcttgagtattaggtggtggtatagtttttgtttcagttgtcaagtgtgattttaagaactgcggattgtctcgtgtatgtatccacatttctggtctttcctttgtccctcctcccatagtcccatattcatcccttctgcataagaactttctgtagccatttttttattttgatttttttgttttaattttttgtattgtggaaatgacagaacatatttctgtagccactttttagcatttctaaatttaccagagacaaattcctatattctcttcctctgataatgtctttatttctctcttcatttctgaagggtagtttcatgggatatagaatttgcaaccaacagtttttttgtttgttggtttggtttttttgtttgtttctttggttggttttttttaagcacttgaaaatgttgtgccacttccttctggcctccatggcatttgagttggcatgtccctacaggcattctgccatttttggtctttgtttttagttttgaaagtttaatcagtgttgctttcttttgttatactttgaggtttgctcagcttcttgaatctgtaagtttatatctttcactaaatgtgggaagcgtcaggaattagttatttgcatgcttttgcagctctggtctcctgtgggactcagataacataaatgcggggtcttttgttattgtcccacaggtccgtgcagctctgttcatttgttttcaggttattttctctctattgtttagactgggtgaattctgttgatacaggtttcagcttctctgattctctcctctgtcgtctccacttttactcaatagagcccatctagatagatttttttttaatttctgttactgtattttatatttctgtaatttccatttgattcttcttcagtttctttgctgacgttttcagttctttgtttgttgccataggatttgtagttgcttgttgaagcatatttatgctgactgttataagtgatgagtcagatggttccaacatctgcctatgtaatttttttatttttgcaggcagtcctcctatttgggtttagtctgtaggtcctggtctactttgtgggctgtgattccaatggcaatttaatttcagagccttcatggtgttattttggtctgtttggcttatatgtatcactgggattctcccaccagtccctgctgttgcccacctgagggaacaggggagctgccccaggctgggccacctgctgcagctaggtgggtggggagtggtggttgtcttggtgtgtggagctggttttcttgttatggggaagatttcctttgatctggggggactgagtctgcctgggttgccttctattgctacgttgggagttgggaaactctgggcctggtcaacttcctattggatgaggtccagggagacacctggccactatgcattccctagtcctagagtccctcagcagcctttttctttccacctttcagaattctcctttgatcatctcctgtctattatttcttaggagggtataatgtgttatcttctctagaccagaaatccttaatggtggtttcaggttgtaactgtgctaaagggagaattggcgtatttttgatgttgagtctttcttttcaaatgaggacatatcattattcagtagataatatttacaacacctacttccttgggttgaagaatgtggttaaggcaaggaaagtacttaacacagtgcctggtgtggagagcaccgatgagtgttggtggtgatgctattccttttgtcctttggtagcatattaaagcttttcttcttttttaaaaaaataaagttctggtgcatttcttgttaggtttattcctattttatccttttttgcttttattacaaataggagcttcctatctattataacttctacctggttctttggcccttatgtgaaaatgttttaatagccttctaaacattgctctcccaaatgagttttaacttgcctatttcttttattttcctttttttgagacagggtctcactctgtcacccaggctggagttcagtgatgcaattatggctcactgcaacgtctgcctcccgggcccccaaagtgctgggtttacaggcgtgagccactgcacccagccttacttgtctgtttcttttaagagtgggaactataattgagcccagagctccaaaaacaaatgaaggaatgaatgagtgaataagctcttcccatgggtttggtgtggtttggggctctactcttaatctaaatgctatgttttatataacctaaaatttcccctaggtgtgttacacgattgtgttgtgttgaacttacattgagactccttttcacatgtgctggtatcagcgtggagcttttctattcattccttgaactattcgtttgggggacacacatagacctctgtgtctttcataaagagtgtccattggccaggtgcagtggctcatggctgtaatcccagcactttgggaggctgaggagggcagatcacgaggtcaggagttcgagaccagcctggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagcagtaccatgttattcagagacaaaggttgtgttgtgttttcttttgttttattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacaggtgagaaacctcagttcctctcagccccttgtcaagactatcatatagcgcaggaatccctgactttgtttgggtccctacgtcctatcctgcttctgtgtatcctgcttctgtgcctttcattcggactcctgggtagagatgcatgtgagtgtgtttattcatgcagtgagctcattgtttctgcagtcagagggtcaccagaaaaagatccatacctattttgtaacaagaattaggaaacagaaatgactgagacatggtctctacttttgagacatggtcttacaatgtagtgatctgagacagtgtgttcatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctaggtcttcatctagtcaaaggactatttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaatattgtaacactggccgcaggttgatatggaccacttccagtgtgactagtgtgattgaggaactgcattttaaatattatgtaattgtaattaattttaatgtaaatagccactcatagctcccctatgggccaggtcagagctctgataaggctggatatgggaggaaaccctggtagagggctgaccgtggaggttcttttggttttggagtgaatcaggaaacagccatcagctgagtgaaggtgagggtggtggtgggtgtttgaagacaagggaaaagtgtgaaagaattgttcagaaaggaaagaaagaagatgtggactggggacgtttccagtgttcgggcatgcagggctccacagttatctacatttgctgtcccttggagcaggagagaagaaaacggttgggacatattctgagcagactgtagaggtaaaatatgtaggtctttttttttggttttttgttttttgagatggaatctcgctctattgcccaggctggagtgcagtggcacgatctcgactcactgcaacctccgtctcccgggttcaagcaattctctcacctctgcctcctgagtagctgggactacaggcacgcaccaccacgcccagctgattttggtatttttagtagagacggggtttcaccatgttggcgaggctggtttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttattatgtacatgagactttaagttgaaaattactcatttttattaatacaaagtaaatttccctttgcttttaatcttcctacatcgttttcagtagggtgtgggattagaggaggggaggtggaagaattataatggtacatttcctatttttgtgcatcttttgcatttatttatctaagcaagtacttaagcagtgctcaccatgtgctaagcactatatgaggttgtgaggagccatcagagactccctgcagccgtgcagggagtccattttcatttgaccagtcaggcagggcagggtttattggtcccatttaacagagaagaaagcagaataatgagcagatggaatctgccctggagttccaaattttaatttcctaaacattgcaactgtatttttcttttccatttcattccaaataaatcattatagtgaaattacattcctctgaaatcactctcaggaaagtactcaaggcgccttttttttttttttttttttttttttttgagacagagtctcactctgtcatccaggctggagtgcagtggcacgatcttggctcactgcaacctctgcctcctgggtttaagcggttctcctgccttagcttcctgagtagctgggattacaggtgtgcaccatcatgctgagctaatttttgtatttttagtagagatgggattttgccatgttggccagactggtcttgaacttctgacctcaggtgatccacccgccttggcctcccaaagtgctgggattacaggtatgagccactgtgctcggcctcaagtcacccttgttagtttggcttaccaactttaaagttttggattgcttttgtcaaaccactgggttgcaagttcacatggtctctcttgtttttcttagctaattgtaagtaaaattcactttggtaatttattgtgtcacatagaattgaagtttttctcttgctgatattattcctattttcaaattttggggttcctgttagcctgattttcggatagctgctacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctttaaaatatgggcctcatatttttataaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggttttgtttcctactttttttatttgtgttaagaaagggaaaaaaatcacaagtttgtctaaccattcagtagaaaaatcgacaaagcatttgcagacaacttggcaaggttacagagaaacggatatactgtttttcagtatttggggaggttggtttgagcagcatttattgagaatttcattagtggggatgtttctattgaaaacacagagttagaaagtcataaaatgttcttgcaatataaggtaataataccaccagcgtttatcttactgttttcatgttctaagtgcatgcacctgagtaaaagcatctgggctgcagtccagtctgagagatgccaggaaaggctgcctaggccagttcagtccagtaaatccctcttcgatcttctcttccacacagacagcggtgatgagcatgcccatgaactgacatgattattttggggaaaatgaaagacttgtattctttttgagatagtaattccactttcaggggcgaatacattttgtttattttatcacccttcagtgagttgtttttgttctttaatcaaggatgtatgtttgaagtaagaagtaaagcataaagtatatgattttgtgtgtgtgtgtttttatcttgctatacctgtagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcggtgagtgtcttgagtagtgttcagggcagggtgttaccattcatgcttgacttctagccagtgtgacgagaggctggagtcaggtctctagagagttgagcagctccagccttagatctcccagtcttatgggtgtgcccattcgctttgtgtctgcagtcccctggccacacccagtaacagttctgtgatctatgagaatagtttccttagcgagcttttccttcaaatactttgcagccaggtagagaagtttggagtgaaggttttattctttgtttcttcgcaatatggatatgaatcttcttttgaaaatgttaaagtaaattacctctcttttcagatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataaggtactggtcgcgtgtgtgttagtggagatgaagcctgtgctctacagacagggagtcacacagacacttttctataatttcttacatgctttgaatgttcaagtataaagtctaacgttaaatttgattgaacagttgtatatttgtggaatattttggaatggaacaccaaaaaatgataatagtggttctttctggattgaagacaaacttttcttttttaaaataaattttattttatatatttgaggttgaccacatgatcttaaaggatacatatagatagtaaactggttactatcgtgaagcaaattaacatagctaccatttcacacagttagatttttttgtgtgtaacaggaacagctaaaatctacttacttaacaaaaatcccaaagacaatacatttttattaactatagccctcatgatatacactagatctctaacttgttcatcctacatgtctgctactttgtattgttttaatatacatctccccatttcctattggtcatttcctatttggcccatttttcaactgggttgtttttctgctattaagttgtaagagttctttactgatttttggatattaacactttatcagatatgtggtttgcaaatatttctcccagtctataggttcccttttcattttgttggttgttcctttgctgtgcaggagctttttagtttgatgcagtcctccttgtttatgtttacatttgtagcctggcttgtggtgcgatatccaaaaaattattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatttttatatattgagtttataccttgcagcttaactgaattgatttagtagttctcacacttttttgtggaatctttggagttttttatgtaaaggatcttgtcatctgcaaatagagataattttacttctttaatttagttgccttttttttctcatctgattgctcttgcaagtactctattgaataaaagtgatgaagctggccatccctatcttgtattcaatcttagtggaaaagcttttagttgttccccactaactattatgtagactgtgggtttttcataaatgggctttattacgttgaggaactttccttctatacataaactgttaagaggttttatcaagaaaggttgctaaactttgttaaatgctttttctgcatcaattgaggtgaacatgtcgttttatctttcattttgttaatgtgatatatcacattgattgatttacatatgttaaaccagccttgcatgccagggataaatcccacttaaacacgatgtataaagtttttgatgtgttgttgaattctatttgctaaaatttttttaggatgtttgcatcagtgcttaatttattggagaagttgacctgtagtttttgtttgttgtgtgtgtgtgtgtgtgtgtgtgtgtgtgtgtgtgtgtgtgttttggtttggcttaggtattaaggtgatactggcctggtaaaatgtgtttggaattatttcctcttgctctatttttgcgaagagtttaagaagtaaactcccaggggatgggagtgactctggacatgggagtgacataatagtgactctggaccctacagtggtgggacacagcagcatctcagtctctacgaggccaggcgcagcatcagcaaggaccccagaatgatggagcactactgtggcttgggccctcgggggcagggaccagtgcagcaactacttctctccctggggaggcaggtgcctgggcaactcagattctccagggctagtccagttccaaggaagcagggttctacagttgtttgtcctgaagggcaaggtaccccagttcaaccaatgccattttcctgggacgtgggggtgccatgttggctcatccctggcaggtgtggctgctcagctcagccaagacactgattccctgtgaagcaggacagtgcttcagctcttgtgcagtggggagtgtgactgctcagactggccaaggcactgattccctggaaagcagggcaccaagtcaactcaggctccaaggggcagggcgcaatggcagctgggaggggaggggcacggcagcgtggccccgcagggtggggtgcatgctgtgatgtggacatcgtttgttcccaccagcactcatgttgaaatttgattccaaatgtggtggtgtgggaggtggggcctagtgggaggtatttgggtcacagggcagatcctttatgaatagattaatgccttttcatgggactggattagttaccaggagtggattgttaccagagtgagttcagcttcctagactctcgtgtttcctctcttgccatgtgagccccttgcatacacctgtttccccttccactttccccatgaggtgaagcagcacaagaccctcgccagatgtgctgcctgatctcagacttttcagacacaagcagggtgagccaaataaaccttttttataaaataagttaccgagtctcaggtattctgttacagccacactaaatggcctgagacagtgtaacagcagctcagtgtaacagtggcccaccggccactaggtgggggtgatatagagcaacaaagcctgaggatggaagaagggtgtggtggctgctcaccctgggtgggacatgctcccgaagtgattccaggtccaggagggcacgttgcagcagcagctggtccatgggggtggggcacaacgtcagttccttctctgaggggagtgctggggctgctgggcccctcttgcttccttatccccacagggagacatcccctctgcttcaggctgatccctctgggggatgggtggtggggggcagatatttccttctctcctttatgtgaccatcctagttttctgtgctctactagatttctgctactccttgatgcactctggggctctcctttagtgactttcatcaaaatatagttgtttgctgctttggctgtctttgtcaggggatgagcgcaaggggctattgatcggccccttgctggcatcactccctcttaaacttttcactgggtactcttttgaactatttttttccccaccatatacatgtatttttaaaacattaatgtgctaatttctattaaagcaatgtggatttttctgaaagttttaatgttttaataagctttttattgaaatgttaatgtacatacagaagagtgcccaaatcataagtgtgcagctagatgaactgtagcacaccagctgccacgccctggaccaagcagtagcctcgccctgtggcctctcccaggcactgcctccccaacccacaaaatagctactttgccagttcctgacgtagatttgttctgcctggttttgacttttataaaatacagcacattctatttagcctggcttctttggttgagtattacagaacacatccatgttcttgtctatggcagacattgatttattgtcattgttgagttccagtatatgactgtgtcaccatttatccattgatgggtaaaatgatttcctatttttggccgttatcccacggcccttaacactaaggtctggatatgggacttgcaggtacggaggggcacacacacttctgctggaggatccctgggtagggtggagactccagggcacctgtgctctgcttcagtgtggaggcttctgtgtcgtgttctgggagcacagcggcttggcctccaccaccagcagcagcttaaagagttcctgctgttccacgtgcttgctgacaattggcctcttcagtttttttttttttattttaggttttcaatgcctgcctggacttgtgttttcatttagattttggtttcttagaactgttgttattctcttcacagcttaacaatgcatttgaaaagatttgttttcatgtggagtgttcagttttgtaataagagggttgttcaaggcatcagtctgccactctgctagaaacagaagtctcccaggcatttctttttatataaagtagttaatgaaattttgaaccgtcttacatgaatttttattaaaatacacttcaggatgtggtgcccattatccattctactcttttgtaacaagtagatttctctgaattcttgaattcaaaaacaatcggggttcctaaacaaagaatatggaatattattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaattgtatgagtcagtggcattaccttcacagtgctgttgcagccatcttcagagcctttccatcatcctaaactgaaactttgtacccactaaactacatcttctcattccctccttcccccagcccctgcaaccaccattttgttttctgtctctgactactctagatacttttgcaaatggaatcatacaatatttgtctttttgtgtcttgtttatttcacttagcatactgtcttcaaggtgtgtccagttgcagcatgtgtcagaatttccttcccttttaaggctgaataatattcccagtgaatgtctttaccacacgttgcttatccattcatctgctgatggatgtgtgggctgttgggaataatgttgcttgaacattggtgtgtaaatatctgtgtgagtctctgctttcagttctgtgtgtaaaagtggaattgctgggtcaaatgtcattctgtgtttaattgtgtgaggaactgccacactgtatccacagttgctgtggattccttacatttcttctagcaatatgtacaagggtttcaatttctccacagcctagaccaccctcattactctgtttttttgttggttggttgattggtttcttaaaaaacaggcatcctagtgtgaagttgcatctcgttgtgatctgtatgttgggaatgactagtgatgttgagcatctttctgtgtgcttattggctatctatagaccttctttggagaaatgtctattcaagtcctttgaatcagatttttttgttgttgaattgtaggagttctttttatattctggatattcaaccgttatcagataaaccattcacaaatattttctctcattctttgggatgtcttttcactctgatagtgtcctttgatgggcaaaggttttttaattttgaagtccaatttattttttcttttgttgcctgtgcttttagtgtcatagccaagaaataaccaaattattgtttagttttttaaaagtatttatgcgattatttggctgatacctgtctctaatgattgacggcacttcttgagggtggcttttaaacatgcaaatttgatgtcactttccgaggctccttccatggcttccctttgcttctaggccgcagcccttgtccttgctgctgctctggcccctgccctcctctagggcctctcttctgctgcctccagctctggccacagtggcctttcattcgtcggtgcacttgcctggggtcctcaacacatgcagttccctctgcctggaatgcggcagctcctccgccccctcccggcctccacctcctcgctgctccttctgaggctggccctgagaccactggtcggtgcggccttccctggaccctctccgaactccccagtactcctccaaacttttctccaataaaccagtggcactcagttgtgctgtccagggacccctgggattttcacgacccctgtcggcggctgggtgaggtcaagaatgtttcatgacaataaggagatgttattgacctcttttcactggaagtgggagcgtcttgcgggggggcagcgggctgaggatgcggctgtgttaggacgtgacagctcgcacaactgaagcaccgccactttcccacaattttttttttttttttttgctttggaaaacatttctcaagaaaatatgcgacttatgttaccatgtaatgggcttgcttctgttattttaaaacaaactaataagtctcctaaatgtttctcggctttattttttgttgttatggttccttttcttctgtttcccccagctttatgaaggtgtaattgacaaacttgcatatctttactgctcacagcgtgctgttttgctgcatgtgtgccctgtggaacgcttcgtggcgctgctgcaaacctccatcacctagtgctgtgagggcccctgggatccgctctcccagctctgcgccctctaccccctgctgtgcctgaggcccccccacctccctcggacccgcgcccgccgctggaaccgcacccatggcccgcgccccgtccccgacccggctttagtttccacccacacgaagaaactcagcctcggtcctgtttaggcacggaaagggctggagaaccgcgtccttccgaggcgcccccagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtcactccgcgccacgccccgcgcgccaacaccggaaggtgaatgttcagaacatttttatcatttaaagccagtatattggctgggcacagtggctcacacctgtaatcccagctacctgggagtccgaggcaggaagatccgattgagcccaggagttccagagcaccctgggcaacatgacaagaccctatctctacaaaaaaaaaaaaaaaaaagccgagagtggtggcgcgcacctgtggtcccagcaactcgggaggctgaggcaggaggatgacctgagttcagtaggtctccagcctgggcgacagagcgagaccctgtccattaataaataaagccagtgtacctaaaataccatcacaacatggaatcagcataaaaatgattattgaactacttgacattcctgttttgtgctaagtctttgaaatttggtgtggcgttttgttttgttttgttttgttttttgagacagagtttcgctcttgttgtccgggctggagtgcaatggcacgatctcagctcactgaaacctcagcctcccaggttcaagcaattttcctgcctcagcctctggagtagctgggattacaggcgcccgcgaccacgccgggctaatttttttgtgtttttagtagagacagggtttcgtgatgttggccaggctggtctcaaacccctgacctcaggtgatccgcccacctcgacctcccaaagtgctgggaccacaggcatgagccaccgtgcccagcccagtgtgttgtactcttatagcacctctcaattcagatctaaattttgtgggaaataatctatatttagatttcacagtattcacagttgaaaaaatagatgtatatccccttgtttcaaatgtaactgaacctagtcacttgtttgaaattcaaattaattaaaattaaaaatttccagttctcggcaccagttacacatttcaagggctcaatggccccatgtggcagtggtcccgtagaggacggcacagctctagacatggtgtaggaagttggagaaggcttccttagggaagcaagtgacggttgagccatgactagaagttggttaacttggcaaaggctgggagttggggaagcagaagagtgtgtcaagcacaggaatgttatgtggaaaggcctgtgacacagggcagcatgacgcctgcaagccagcgtagctggagccaggacagcagcagagagtcctaggagctggagaggaaaatagagaggcaggggatgaggccgccttaagaggctatcttcatcccgagacaccaggaagccctgggagaacatttagctgggacagcgtggttagatttccatttttcaaaaagcccctttgctactgggtggagatagtttgcaggaagtttaggggaaggaggcacagagagggagaagtggtgggtgctagagctctgagaggtaacattggaggggtagtaggtctgggggttgtgaggaacaaggggttttcagggagtaccccagggcccccaggtgtctggctgggatgccaggtggagtgatgggcacctgtgggacagccaggcagagacatctgaggcggcagctggggaactgtctggaactccggttgatgtgctacctgggcttaagatgtactcccaagagttaccaacacctacacttgggagtgggtgcattatccagggaggagccaaggttgaacacaggtgggtttttgttcagcattttaaaaaattttcatttttttttgtagagacaaggtctcattttgttgcccaggctggcctcaagagatcctcctgccttggcctcccaaagggctgggattacaggcgtgagccactggtcccagtctgttcagcactttttccactagcttagtatctccacatacctcaaagagatcaccaagtccaactcatacatgcaaaccagtgctcaggaagtccacatgatcctgctgtggttcatttgaccaaaactgagcggtggagctaagcaaggctgtttcacagaagccagatatataagtgtcctcaatatggagggcagtcaccatctcccagtgtctctgactgctgcaggcacacttggcaaactgtgctcaggtcagggatggtctgggtgggggctccagtttctgccactcaccagtgatgtgactctgggcaatgtacaaaatctcttgggttttaagtttcttagatggggataataaaccaatcttgcagcatgtgaggatttaatgagactacagttcccatgaaggggatggggtgctgaccttcccacacagtcaaaaatccacatataggccgggtgtggtggctcacgcctgtaatcccagcactttgggaggctgaggcgggcagatcatgagttcgggagtttgagaccagcctgatcaacatggtgaaaccccgtctctactaaaaatacaaaaattagtcaggcgtggtggtgcgcacctgtaatcccagctactcaggaggctgaggcagaagaattgcttgtacccaggagatggaggttgcagtgagctgagatctcaccactgcactccagcctgagggacagagtaagactccgtctcaaaaaaaaaaaaaaaatccatatataactttcaactcaccacaacttttgttaatagcctactgttggccagaagccttaccaataacataaacactcaacacatattttgtatgtgatttgtattgtatactgtattcttacaatgaagtaagctacagaaaagaaaaagtactaataaaatcataaggaagagaatgtattcactatcactaaatggaagtggatcatcataaaggttttcatccatatcatcttcacattgagtaggctgaagaagagaagaggttggtcctgccatctcaggaatggcagaggcagaaaaggtgggggagatgggaaggaaggcaggagacgcacacatgctgagaaattcatcgttatttctgtctgacatttttgctttttcatttctctaaatatgtttctttgtgataccaatcctccttccaccatttgctttagttttggtgcccgtaccatagaaaggtccatatggtaaaagaagtcacaagcagtcttgaataatcggaacccctctgccagattgtcgaatgtcaacttattttctggtactgcgtctacatccacttcttcatcatctggcactgattcgaaagcactcatctccatcaagtggtcttctgttaattcctctggtgtgatgtctattcactcttgaatttctccaagatccatatcctgaaagcctacattccccaccttttttgccacaggcacactctctttcatgatttccttgattggccctattgtaaatctggacacagttttctccagtaggaaggctgggcactgagagccttcgaaccttctgcttcaccttttgacatttagggcccaattttaatgcatttaaatgttgcctccactctgaaatgaacatgggacgtctgtaatgtgtgaaataggtgtgtctcacccccttcatgaatattcatagagccttctataacctgttgaatatgtacatttagccaaccctttcagcataacttcctgtctcacctttctgtccctggaagtgcctacttttggtctttgctggaggctagacttcccagcctgtcaagacagccaggctgcaggctgcaacctttctaagaaataacgcttttgggctggcccagtggctcatgcctgtaatcccagcactttgggaggctgagttgggtggatcacttgagaccaggagttcgagcccagcctggccaacatggtgaaaccccatctctacctagaaaaaaatacaaaaattagccaggtgtagtggcatgtgcctgtcttcccagctaaacgggtggctgaggcaggagaattgcttgaacctgcgaggcagaggttgcagtgaactgagattgcaccactgcactccagcctggatgatagagctagactctgtcagacaaaaaaaaaaaaaagagagaaagaaagaaagaaagaagaaagaaagaaagagaaagaaagaaagaaagaaagaaagaaagaaagaaagaaagaaagaaagaaagaaagaaagaaagaaagaaaataaggctcttggcctggcacagtggctcatgcctgtaatctcagcactttagaaggtcgaggtgggaggattgcttgagctcaagagttcgagaccagctgggcaagatagtgggacccctgtctctacaaaaacaagtttgaaaattagccaggcatggtggcacacacctgtagttccagctacttgggaggctgaggtgggggattgcttgagcctgggaggttgaggctgcagttagtcatgattgtgccactgtactttagcctctccaaatttgtagatctcataattttaagtcaccatcctccaccagtctttcgttttaagttgttgtataatgatatcagtttttcttgaatcatattagaatctatagatatgcttttcttatagatatcctgcacccacataaaagctgcattttctctatttctctgtccttccttccttccttctttcttcttcttctttcccccccacccccctacagagcctcgcttccaggctggagtgcagttgtgtgatcttaggcttacttcagcctccacctcctgggctcaagtgattctcctgcctcggtctcccaaagtgctgggattaaaggcatgagccactacattcagccaaaagctacattttcaagactagacaaaaaggtatttggcaaaaagagcaaagtttcatgtctgctagcatggctgcagtgatgacactgtgaatttccttttctttttttacaatggttcttacactggattaatttatcttgaaatggtgggcaaccgcagctgcagacctcagtctacagtacatatcaatcaatccacctttttcttgtactgtcaagacttttctctgctttttggcagcacttccagaatcactagtggcgcttcgtacgcgtctcgatgtcttcttcagatttatggtattgcactaaacatgaaaaatacatgagaaccacgagagattacttttcactgtgatacacaatctacaggagagacaagtgctcacacggagatggctagtgtcacatggcattttaagtggacactcgacacctgagctcactgcaatagtagcaggaggggcgacagaattactacagtagtacagtgggctcccattaatttatgcaattatgacttaatactgcatctttacatttgtttacatttctcttgactgaatggcaccatgtactgtgtttgtgtgcataacttttgataaattttaactgtttatagttgatttatgtatgttttatggtggtaaatgataaaaatatgctagtattttatgcattcatgacacacctttttcttaactttttcaatatttctaggctacaaggttcatctgcaagtttcttcaaatggttgcaatgcttactgcaacctccatctcctaggctcaagtgatcctcctgcctcagcctcccaaagtgctgggattacaagcatgagctactacatctgtccaaaagctgcatttccaagaccaggtaaaaaggtatttggccaaaagagcaaggtttcacgtctgctggcatggctgatgtgaaattttccaatacatttttccaatatatttactgaaaaaaaaaactgggccaggtgtggtggttcatgtctgtgatcccagcaatttgggaggccaaggttgggagggttacttgagtcctggagttcgagaccagcctgagcaacatagcgagaccccgtgtctctttttttttttttttttttttgagacagagtttcactcttgttgctcagactggagtgcagtggcatgatctcggctcactgcaacctccacctcccgggttcaagtgattctcctgcctcagacttctgagtagctgggaccacaggcacgtgccaccactcccagcttttttttttttttttttttttgtatttttagtagagacgaggtttcaccatgttggccaagttgttctcaatctcctgaccttgtgatctgcccatctcggcctcccaaagtgctgggattacaggcatgagccatcacacctggccaaccccgtgtctgtttaagaagatttaatttaaaaaaaaattttttaagaaaaaatctgtatgtaggtggatccatgtagttcagacttgtgttgttcaagggtcacaattgtatctgtggtgactgatacgaaacagatgaccaaaaaatgatagttttatttccccatctggtcccatttaaaagaggtgtttaggtctgagaattttcacacgtacaaggttccacagtcaggatgccaagaagctgcacccctcttgctggagtccagccctccccacccaaccctgctgactgctgatgcgccttccatccctgtcacaccgttgtctcgggaaggttgtgtgagtggagacacacagcatgggatctttgtaactggctgctttcgctaagcatcatgtttttcagatccaccccaatgctctgtgtgtcagtggcatgttcctttcaattgtggaatggtgtttgcctgcacagggagacacaggtagttacctcttcatccatgggaggacgtgcggttgtgtccagatttaggcgattatggatagagttgctgtaaacatttgtgcagaggttttcatgtgaacacaatttttccttactccagggaaaatcgttatgggactgctgggccatgtggtttaacacaactgtcagagtgctttccagtggcacctcactatggttttgatttgcatttccctaatgactagtgttgatggtctctcataggcttgctgtcttccacatacagcgtcctcttcggtgagggtccaagtcttttacccacttttgtttggatggttttctaactgttgattttgagagttcttcatatatgtcggactactttctttgttggatatgtggtttgtagatattctctcccagcctatagctgtcttttcagcatcttttaatagtctcttttgcaaagttatattttttattttgatcaagtctaattgatggatttttgcttttacatgcatttggcatcatgtctaagaacaatttccctaacctcaagtaatgaagacttcttcctatgttttcttccaaaactttaaacactctctctctctctcagcaaatacggaggaaacattcatgacaattgcaattctggtttctgtagctggtcacgtggtcctataactaccttcttccactccccagtctgtattccctttgccttcaggaagcctctgctggttgtggtttttaacctggtggggaaccttcattcccaaaggttctggacaattattaatcctgcctagattgggctgttgtgcttttctattgatcttaatcacagcgcatgccacgagggccctcctataccccagacatgctcttccccagtccattgtgaagcagcagggcagtttctccttggtggtctggaccagccacccccaccagcgtagttaactccttctttacctgttgatccagaggcatgaagagcttggcgccatcaggtggcagcctaaacttccagcgcaatggatcatccctgtgtctcttgggggcagcattcctccctctggaactaagatctctaggccagcagagcataaggtggtggggacaaggagcaaaacttttgctagtgggtcactaggggtgatggtgagtagtgctatgctaggagtcttggctatgggaggaatagcaccatgtattggacactgattccgagcatatccagccttctgagagccttgccccagccttgaaaggcactgccaccgagctgcactgtcactgagtcctccaaaggccattattccaccatctgtcaagccagctgcctcaggacagtgggagcctggaaggccagtgaattccatgaacattgggccatcgcggcatttcttttgctgtgatgtgagttccttaaccagaagaaatgctgtgtggataccatgacagtggagaaggcgttccgtaaacccacaggtggtagtttcagcagaagcactgtactcagggagggcaaatccatatgcaaagtgtgtattccacttagaacaaatactgcccgttccatggtggaaaaggtcgtaggtaatcaacctgtcactaagtggctggctgatcactctgggagatggtgtcatactggggactcagtgttggtctctgctgctggtagactggacatattggtggctgtagagagttcggccttggtgagtgtgagtccacaatcctgagcccatgcataacctcatccctgccaccatggccactttgtttctgagaccctggggtgatgacaggggtggctggggaaagagactgacatctacagaatgggtcatcttatttacctgttattaacgtcctgctctgctgaggtcacccttcagtgagcattcacataggcacacatatcatcacattttctgccccttcagtgaggtctatccacatacctcttccccaggcttgtctgtcacacatctacctatcatgttccctgcaagtccctaaccagccagccaaattattggccacaacccatgaattggtatatataatctcacgtctggccatttctccttccaagcaaactgcacaatcaggtacactgccccaagctctgcccatggggagggttactcttcacctttgtcctttagggatatcctagaagggggctgtcatgctgcagctgtctgctttcaggtggtacctgggtatcacacagaaccatctgtaagggccaagagaaggcctgagccttctctccctctgtcatctgatcctagagaactccccatgaggccattggtgcaggctgggagagagaaggcagtgtactaggggtggggaccatgggcatttgggccacttatgcagccgacttatgccttcagggcctgctggggcctgttcacacacagacccctttcctctgatgatggagcgctgccatgcatgcccacctcatgcttcatgggtcagataaaactcagttcatgttggtcagctcaggtcacatgggaacttggtgatccccagttaagcgttcagcctagtggcagatgaacagatgtttctcaaaaggaaaatagttctccctctccctctccctctccctctcccttccctctccgtctccgtctccccacggtctccctctccctctccctctttccacactctccctctgatgctgagcagaagctggactgtactgctgccatctcggttcactgcaacctccctgcctgattctcctgcctcagcctgccgagtgcctgcgattgcaggcgagcgccgccaagcctgactggttttcctatttttttggtggagacagggtttcgctgtgttggccgggctggtctccagctcctaaccgcgagtgatccgccagcctcagcctcccgaggtgccgggattgcagacggagtctggctcactcagtgctcaatggtgcccgggctggagtgcagtggcgtgatctcggctcgctacaacctccaccacccagccgcctgccttggcctcccaaagtgccgagattgcagcctctgcccagccgccaccccgtctgggaagtgaggagcgtctctgcctggccgcccatcatctgggacgtgaggagcccctctgcccggctgcccagtctggaaagtgaggagcgtctctgcccggccgcccatcgtctgagatgtggggagcgcctctgccccgccgccccatctgggatgtgaggagcgcctctaccccaccgcgaccccgtctgggaggtgaggagcatctctgcccagccgcccagtctgagaagtgaggagaccctccgcctggcaaccgccccatctgagaagtgaggagcccctccgcccggcagccaccccatctgggaagtgaggagcgtctccgcccggcagccaccccgtccgggagggaggtgggggtcagcccctgccaggccggccgccctgtccgggagggaggtgggggggtcagccccccgcccggcagccaccccgtccgggagggaggtggggggatcagccccccgcccagccagccaccccgtccgggaggtgaggggcgcctctgcccggccacccctactgggaagtgaggagcccctctgcccagccagccgccccgaccgggagggaggtgggggggtcagccccccgcccggccagccgccccgcccgggaggtgaggggcgcctctgcccggccacccctactgggaagtgaggagcccctctgcccggccaccaccccgtctgggaggtgtacccaacagctctttgagaacgggccatgatgacaatggcggttttgtggaatagaaaggggggaaaggtggggaaaacattgagaaatcggatggttgccgtgtctgtgtagaaagaggtagacatgggagtcttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcattaagagtcatcaccactccctaatctcaaatacccagggacacaaacactgcggaaggccgcagggtcctctgcctaggaaaaccagagacctttgttcacttgtttatctgctgaccttccctccactattgtcctatgaccctgccatatccccctctgtgagaaacacccaagaatgatcaataaaataaataaataaataaataaaaaggaaaatagttatctgctgaggatggcagggctgtgcaccaaaatcttaagggcctgtgctgcgactcacctataggcgcctgccaaaggctccaaacttatctgccactgatgcttcgagcaatattggatctgctgggtcacatggtccctgtggcagagtagcatgcacggacacctggacctgctgcacggccttctcttgttctcaacaccagcagcctttcaggtcacttgttacatgagctggagcaacacacccaaatgaggaatatgcttcatcaaaactccaaatagttcaacttgcattataattcagctagccacaggatgagattctgagtttgattttcagcaatctcagctgaggggctacctgggctaagggtttacttgagggcacacaaaggagttttcaggtcatttatgtgatacttgagttgggaattggaatccctgagctcattcttttatttcccctttgtctagtgacaatagaagcaaccatctagtattcattagtttgctgaaaatgtttgaaatgccctatacacagtcacccagatcctagcttcttataaagtggttgataggagtctccaatggtgatatttgtgtatctctattgccagattatgccatgaactatcagtgctctattattggaaatagagttattaacaactttaaatgaaatctgtttagagaaccaattccagaaaccccagaacaaacccagaacactcattctcaaaattctgttcctctagaaccattatctgtaccaaaatctgtattagtcagagtttttgagaaaaacagaaccaatatgatatataatgggctcacacaattatggaggctgagaagtccagttggcagcctggagacttgggagaaccaatgatgtagttctagtctgtgttggaaggcttgagaaccaggagaactgatggttgagttccagtccaaaagtcagcaggctcaagatccaagaatagcctatgtttcagtttaagtccaaagacaggaaaagaccaatgtcccctctcaagcagtcagacaagaggagtcccctcttgctcaggctttttgttgtattcaggtcttcacttggttgaattatcctgcccacattggacagaacaatctactttactcagttcaccaatccaaatactcatctcaaggagaaacaccccacagacaaacccagaaaatgtttagccaaatatctgggcaccctgtagcccagtcaagttgacacataaaattaacaatcacagctgttgtggaattaacctaaatgtctataacgaatgaataaagaaagtgtgtgagtgtgtgtgtgtgtgtgtgtgtgtgtgtgtatacatatatataaaatatacacaatggaatattatttaaccataaaaatgacatgctgtcatttaggcaatgtggatgagcctggaggaccttatgttaagcaaaataagtcagacacggaaagatgttctcattcatatgtgggagctagaaacattttgaactcatgaaagtagagagtagaattgtgggtattagaggctagaaagggtagagaggagagaaggctgggggaggctgggtaccataccaaattacagttagataggaggaatgagttctgttcagcaacactgtagggtgaatgtggttaacaataatttattgcatattttcaaaaagctaggagagaggattttgaatgttcacaaaacaaatgaaaatgtctgaggtgatggatatgttaattatcctcatttgatcatttacacattgtatgctcatatggaaatatcactctgtatcccataaacatatagaattattacatgtcaactaaaactaaaaggaaaaaattaactatcacagagatgagccagaagctcataaacacctttttgaagtcactgtcctgaactcctcacatgctatgatttccctggtactttccagctcctaggagctctccttttcagcgctccagctgagcaagggtattatttacttcactctgcaccttgcttgtcatgaccatgcccacatccagcgtcaagcaataaaaggacagaaagagtaaaaaagcaatggagtgcacccacctgcttagaccatctctctagttatcaggaagtgaggtgccagtgggctgcaggggactggggcataagaaaatggagtaaagagaaaagagtttcttgcactctctctgcatgttaggagactgtttcctgctcctcagccagatcaggaaggcttctcctgagccctctctgtttgcacccaagtccacttccaagttcaggcgtccttgaagacagactaagagacaccaaagaagggaaatggtaaaactcaatgccagatcagtgttactttgaattatggtgttttgttttgttttgtttcccaattctcctggggttatttggttttaaaactcttcaaatagcttctttatgtattctctctgatttagtgggagggacacagtgaaacgtgcttactccattttccccaaaactgaaattcccttaatttttttgaaactaaaaatgaattcctacaaacatatgaattttttttaatgctcattgttttgaaataattatagattcacaggcagttgtgcaggagtgtacaggaaggttccttgtgccctttacccaactgccccagggctagcatctgacataactacaatatcaaaacaggaaactgacattggtacgatccacagagcttactaatattcaacgaggtagtgatgtgctcacttgggtatgcgtgcatatagctgtctgtaatgttatcaagtatgtacttgtacctatcatcacaatcaggatgcatacctctgcaccacaggcttccttatggtaccactttagaggcacacatccacacgtccttcactccatccctaacccctggcaactattaatcttctcttcatctcagtaattatgttatttcacaaatgctatatacgtggaatcatatagtatgtacctttttaaaactgacttactttttaagattgataatttatttgaggttcattcaagttgttacatgtatcagtagtttgttctttgtaatgctgggtaatattccataatatggatgtaccacaatgtatccaatcattcaccattaaaggacatctgggtagttttcagtttggggttattacaaataaagctgctatgaacatttgaatataaaattctgtctaaaaacaagtttttatttctgtactagaaatgcccatgtttgcattttcttggtcctatggtaagtacattttcagttttataaggaactgccaaactttttccagagtggctgtaccattttacattttcaccagcaagtgtgggtgctctggtttctctgcttccttgccaggatttgctgttattctgttgttgttgttgttgttgttgttgttgttgttgttgttgttgttgttggagtctccatcgcccaggctgaagtgcagtggtgtgatctcagttcactgcaacctccacctcctggtttcaagcaattctcctgcctcagcctcccaagtagttggttacaggctcataccaccacggccggctaacttttgtatttttagtagagatggggtttcaccctgttggccatgctggtctcaaactcctgatctcaaatgatccactcgcctcggcctcccaaaattctgggattacaagcctgagctactgcacccagcctagtgctaatcactttttaaaaagccattctaatatgtagtgatgtctcattgtggttttaatttgaactttcctgatggctaatgttgctgaccatcctttcatttacaaagaatattttctttggtcaaatatctgttcatgtcatttgcacatttttaatttgattacttatttattttatgttgagttctgagagttctttattcttgacacaagttctttgtcagatatgtgatttgcaaatattttctctcattctgtaacttatctttccatcatcccaacagggtcttttgcagagcaaaaaaaatttaattttgatgaggtccaatttatccattttttttcttttatgaattgtattttgatgtcaagtctaagagctctgcctagttcctggtcctgaagattttcttctatttttttcctgaaaatattacagtttgacattaagcccatgatccttgtgttatgttttgtataaaatgtgaaggtcgggccaagcctcatctctttgcctatggatgtctgattgttcctgcagcacttgttgaaagggctatcactcctctactaaactgctgttgcatttttctcaaaaattaattaagcatatttctgggtggggggtctctgttctgcaccagtaattaatgtgtctatccctccaccagcaccatactgagttgatcactgtagttatagagtaagctttaatacttggtacagtgatttcttccatttaattattctttttcaaaattgtttcagctaacctagggccactcccttttaatataaagtttacaataagtttgcatatgtatacaaaaaacaatgccaagatttagaattgtattaaacctgcaatttgggggaagctgacatctatgttgagacttcccatccctaaatatggcatgactctccatttatgtagatatttgatttctttcagcagaattttgtaatttgcactatattctcctgtatatgttttattagatttatacctacatattaatacttcatgtatttcgagcagttgtaaatggtattgcagtttttattttggtttccacttgtttattgttaccatagagagatgcaatttgtgtacgtgtgttattcttgtgtattgcagccttgatattctcactctttatatcaaggatgttttgtttattccgtgggactgtttatgtagatgattatgccacgtgcaagtagtgataattttctttctttcttttcaatctgtgtactttttatttctttttctggtcttattacactggctagaacttctagtactatcttgaattaaaatggtgaaagggaacattcctgccttgttcctgctcttaaggggaaagcattcattctttcaccattaagtgtgatgttaactgtagatttttgcaaatgctgtttatgaagttggaggaaattaccctctattccaagtttgctaagagtttatatcataaatgggttttgaattttgtcaaaaccttttcctatgtcaattgataagatcatatgatttttcttcttcagtttacaaggcagaatatgttgattggcttttcaaatattaaaacagtcttgcataacttgagtgaaattcctcttgattgtggtctactactctttttatgcattactaaatttgatttgctaacattgtcttgaggatttttccatctaagcttatgagccaaatcagcctgcagtgttctttcctctgtcccttcctccttcctccctcccttccttcctttgtgctgtctttgttttgttttgatatcaaaataatgatatcatagtcctttctcttctattttctggaagagattgtgtaaaactggtgttgattcttctttaaatatttggtaaatactccagtgaaaccatttgggtctggatacattgtgttcaggagctttttagttacaaatccaatttatataatggttataggactattcaggcttttatatatttcatcttttctgagttgtggtaatttgtgattttcaaggaattgatccattttttcctaggctgtcaaatgtatgagcataaaatttttatagcatttttcatagatgcagcctcttttgtgatatttcttgtttcattcctgatattggtgatttgtgtgttatctcctttcatctttgttgatcatgctagaggattatcagttttattaatttttttaagaacctgttttttatttccttaatgttctgcattgctttcctgtttttaatttcatcaatttctgctcttcactttccgtcctatttgccttaactttattttactattcctcttttagttttttgactactggtttgagaactttccatattactaaggaaataatataaggatttagtgctataaatttctctctcagctctgctatagctgaatccctcaattttttttttaagacagggtctcattctgtcaccgaagctggactgcagtagcacaatctccacttactgcagcctcaaccttctgggctcaagcaatccccccatctcagcctcccaagtaactgggactacaggtgcatgccaccacacctggctaattttttgcagagatagggatttcaccatgttgcccaggctagtcttgaactcctgggctgaagaagtgatccacccgccacagcctcccaaagtactgggattataggagtaagccattgcacccagccgcatccacaaattttgatatgccatattttcattgtgttacttgcgttttaaaaattccctttgagacttcttcttgtccacattgtatataaatgtttactgcttaatttccaagtgtttgcagatttttctcctgtctttctgcaatttatttctagtttgattccattgtggtcagaggacactctttgtatgatttcggtttttaaaaatttattaaggtttgttttaagatctagagtctgttctataagagcttgaaaataatgcgtattttgctgttgatggatagagttttccataaatgttaattataccctattggctaataatattgttcagttatcctatattcttgctgatttttttgtctagtaattttacaaattctgaaagtgagatgttgacatatcccaactataattatggatttttctatttcttttttaagctctatcaggttttgcttcatgtgttttgaagctgtgttgtttggtgcacatatatttaggatcaagatatactcttgctcttttgttattatgtaatattcctcttttgtcctagaaattctttttgccatgaactctatctgatattattatagcatctcctgcttttttgaaagttcctgtttgtttgcatgaaatatttttttttctgttctttcacttccaatctgttaaatacctatgccatggtattagaactgaatatcttatggacatcctataatgggtcatatttttgcatttactctgctatttctgtgtttttcccagatttaaccaaactgcaaagtctgagggcatggttcctaaaatttccctcattcctgacaccaacagcaagttttggaggtttccaaagcaccttaagtttcaatcatttgctggaaggactcattgaaaactgctctacatgtggttactgtttactgcagggaaatgatacaaatcagaaccagcacagagggcagggctaggagggtctgtgaagcctctgttgtcctcaggtgcattactctcccagcatccacgtgtgacaataccatgaagcactgccaacctaggaacctcacccaagccttggtgtccagagtgtttcctggaagtgcattgtgcagccataattgacagatctgttggagactggttggaactctgtcttcacctctccctttcccggaatctggggctgacagcacattcctaggggggcccaccatgagccagctggtagcataaacttcaggtatggtctgaggggcccactatgaatagcaaagacccttctgtcacatgggcttcaggactacttaccaggagccaggacaaaggctagacctctctttgggctaggccaaattctttaccacacagaaattatatttaggactcaaatgtgccatttttatttgctttctgcatgtttcttatgtttcctttatcctgttttgtttcacttgtcatggattagttgaacagtttttagcatttcattttgaattatttattcttttgggtgcattgctttgtatcgttttctaagtggctgctctaggattgattataatatacacatgtaacttatcacagcctgctggcatcaatgtttcaccatttcatgagaaatatcaaaagcttacttttatttccccttttcctcccccacttaaacatgtaattatcataaatatttcctcttcagatgtagagcaccgcagcagatgatgttattattttttgcttcaaccataaaatacaatttaagaaactcatcatagtctattatatttaccacatgattaccccttctgttgttgctatttctgatttccttatttcctttttgttaggagagcttccttcagccatttattaagggtgggttttctggtaacaaattatcctagttgtccttcctcttagaatgtctttatttccccctcatccctgaaggatacgttcactgaatagggttctgggcagacagtttttctcagcacctggcgatggtgtgttgcccccctctacctcgtggttttagagaagcccaccatcctcagaaccagtgtatcttaatgcatcatttttctctggtggtttaaaaaatttttttctttgtctttcctttcctgaagttccattatgatgtgtttatcctatttggggtttgctcagattcttgaatctgcaggtttatttctttcaccaaatttgggacgtcttcaaccactgtgcctttgaatactttttcaccacacattccttcctctcctcctgggactctggtgacaggaacgctgggccttttgtcactgtcccacccatccccaaggaggcattcatttctcagtctcctatctctccgttgttcctatgggccagctctattaattgtctttgaatcaacagactctgttctctgtcgcctccactctgctattgaacccaactgcacattttttcatttagttattgtatttttcagttgtatgattttcattttgttcttgtttcaagaaaattcaccattgttttctgaagcatttttatgatggctgctttaaagttctaatatctgatttatcttgattaatcttattttgctatttaagttgttttttgttttgttctgttatgtttttgagacagagtcttactctgatgctcagactggtgtgcagtagcatgatctcagctcactgcagcctcaaactgccgggctcaagcggtcctcctgcttcagcctcctaagtagctggcaccacaggtgtgtgccaccacagctggctaacttttaaattgtttgtagagacaggatcatgctgtgttgcccaggctgatctcaaactcctggactcaagccatcctcctgattgaccttccaaagtgctgggattacaggtgggagccccctcacctggcttcaagttgctttttatgtttcctgatgtgacaaataatttcaaatatattctggagatttcggttattatgtaaggaaactttttatcctatttgaacattccagttcagtccatggtacccttatttggtttaccatataggccccagcctgctttaggggaaatgtagagtcaatgacaatttggttttcaaagccctccccgtgctattctggtcgggtttgttcttctggatctgctgggcctctggttcaatccctgcgcatgttgccggggttgccctgtgcggtgggggtaggttaaggaaacgctgggtgctgggtgtggtctctgagccacggtcagcagagcctgttgtggcctgggtgtgatgctgagggccaggcctgaacggagctgctgtgacatggatcagggggaatctcctcgctgggtctccagtgagatgcccttttcagtcctttcaccagagagaacaggctctttttcttttcttttttccccctgcaggttttggcagttacaggttgcagggttctctgggcccatccaggagatgagagagaaaaagaaaactcagggcctggtacagcgtcacccccaaagtcccaaggttcctggacagcctttcttcctctccatctcctagagtcctcttacgtctgttaaattatttccagggtgtctagttgtatttagagggcagatgccacctcgtcatagaacaccagggtccactctccaggcatttggaaagagttgccacgaggtcctcggaagggtgtgacagttcacacgcccaccagcagcgtttccacgtctccatttcctctgcccctgacagcatctaatgctatgatttttgtttgaaaatttggcttttggttcctttatgaggtgattaattaatacaggctgctggctccttcccatgaatccaaaccttggagatgccatcaaagggatgacagttgatggagcccagaacctaagaggaaacccctgagagcctcgcagaggctgggcaaatgtggtggagtctggggcaggaggggaaccacagtctgagtggaggaggccacacagcacagcccgggccagtctgcagctctctgctccggggcccacctggggctgtcatctgccggccctgctttcctgtagaagatcccacccataccagccccaggaatccaggcaaggccagagcacctcaggagcctcctggagtgatggccatgacacctggtcaagctggctggtagcccctgggcagccctcctccccagcccaaggacagccaattacagcacagggcagccctggacagacagcaccagctagaaggacggggcattccctgcagaccagagcagcccccggggatgagcaaagagggccccagtcatcctgccagaggctctgccccgaggagcccctgcctgcctccctgaaacccaccaggaaggtgtcaactggggcctaggacgaaggcagctgaccgtccccagggaacagagagcggcctgaggaaacgagacagccaggggagtgaactctgggagggaaaaaccgcaaggtttttccttggaggagggagcagatgagcgggtaagaccggcaaatccgtcacataccctcaggacgcagggagcgcggctggaatcagcagttatgcagaaaacgcaggccaggttactggactggaacatgcgggcgcttaagtgatgaacttggtgggaagtttggagagcagaaaatgaacgagtgagacaagtcaggctctgagctcttttagaaggatctgaagggattgaggaggcagaggtgagggaggagaaatattcagtgcttagaagaggaaaaatgaatagataagaggaggtatctgaaaaatgactaggaacttcccccaattaagaaaagacgcacatcctcaaactgaaaaggcctgcagagcgttaattacattttaaagttaaaatgttctgtgtaatttcaaagaaaagcatctacattttgagtcaaaattgctaaaaacttccaaagagaaaaagcaggtaaccctcacaggaacgcgagtggtgctgacattagaattgcagcacagacaacggatgcaaaaagaaagggggtgacagcttcagacgcgagaggaaaggaccctggaacccagggctgcgtcctgctcaccgccatgaaatatgggcacgcaggaagccatcctcagtcctatcagcccccttgagagtcaaccccaaaaacactcttggagaaatatttcagcaagaaaaaggagccagggagaatgctgccaggtctggggaggagtggtgcttcccgagcgtgaatggttcactgccatctaagtaagcaatgacctacgcgtgtgccgcacagtccagcttcctcagaggcggtggtggcctggtggaggaatgtgggctggctgggtggccacagagaattactgtttccattaaaaggaaatgtgttctggccgggagccgtggctcacgctgtaatcccagcaccttgagaggctcaggcaggtggatcacttgaggtcaggagttcgagaccagcctggccaacctggtaaaaccccgtctctactaaaaatacaaaacttagctgggcgtggtggcaggcgcctgtaatcccagcactttggaaggcggaggcgggcggatcacttgaggctaggagttagagaccagcctgaccaacatggggaaaccccgtgtctactaaaaatacaaaaattagcctggcatggtggcacatgcctgtagtcccagctactcgggaggctgaggcaggagaatcgcttgaacctgggaggtggtatgttgcagtgagcggagatcacgccactgcactccagcctgggcaacagagcaaaaacctgcctaaaaaaaaaaaaagtatcacatggagacgtgtgtccgtttgggactgttttccagcctttccacactctctccctccccatctgtccctccatctccaccaagctgtgttttgatgttgtgtttgcatgatttggtgtatctggcattttaacatttgcagggcaaatttctcttcattttgggtttttctctgcctgttcttttgtgtttattctttcagataaacttaattctttttcctttaatgtcctctgataaaaatatgcttcagagaccactgcatgtcactgggttatcagttttaatagctgcaaaaattacatggagtgcttagaccatcatttatttaaggagtctattttggttgttttcacttttcccccatgcccagtggcgatggcttttgtgcagtgtagaggttgaaagaaagggagttccactgcttaaactcaaaatgtgtttctactatagtgggccctccctacctatgggttccaattcatggattcaaccaaccatcagttgaaaatattcagaaaaagaagtggatggttctgtctgtactgaacatgtacagacttttttccttcctgttagtccctaacagtataacacctgtttccatagcatttacagtatacgaggtattacaggtaacttagagatggtttcagctctacaggaggatgtgcgcaggttacatacagatactatgtcatgcacaaggacttgagcttcggtggattttcatatcttcaggggtcctggaaccaatcccctacagaatcctagggatgaatgtatttgccagtcctgtgacttggaccaggcatttaatctttcccagcctccatttgctaatctttataatggtgataagtgttaaacccttcactgtttcagtggggcacatcccagcacacgctggtgaccacttttctggagtagattatttgaagcaggattggaatcatcagtcagggagtaggtacatttcccctccacatttgcaagtcacttcgtgttcctaaacggttgtaccagatcccatgtcctcccacagggcaggaagtgcccatctcctgactccactggtggtgaaggggctcagggcttttcatcttgccagtctggtgagcacaaggcgcttttcattattgtttacatttgcatttttattagacagcaggagggttttagcatctcttcaagtgtttattggccattctcctgtctcctgcaatttgtgccaatcctctgcccatttttctgttgggttggttgcctttcacatattgattttgtaaaagctctttatatattctccatttaaatcccgtggctgcttataaatgttataaaagacttttccctggtatgatgcttaccttttgacgtgtccatgaggcctttctgtattcagaggttttcaatactcgtataatcaaacctggtagttttccttttggttttgaggttgtgtcttgtttgggtgagtctttcctacccctttgactacagaaatgccctttcatttataatatcctcctattatgaaacatatttccacattttctaaatttttaatttttagctgagaaataaattagtaatgattaaagtattaattacttttatcttgttattaattattggttttatttatttacatgtagttggcttacatttagtttagtttaacttaattactttaaagtaatgtataaatatcttcagtttgtaccgcatgttctcactcataagtgggagttgaacaatgagaacacatagacacagggaggggaacatcacacatcagagtctatccgggggctgggtgcaagggaaaggagagcatcaggacaaatacctaatgcatgcagggcttaaaacctagatgacaagttgataggtgcagcacatgtatacctatgtaataaacctacatgttctgcacatgtatcccagaacttaaagtaaatttttaaaaaaattaattaattaaaaatatatatcttcagtttgtaaatgtcccggcaacacgggaacagagttaaaagagtgtgtgtcgtccttagctgctcccaccccctcatctcctccctagccatcccagccaccagtctggcctgcgcctttcaggtttcttcctagacgctggcatacatagatcactattttctgccatgtggtatcttttaaacacacacgattgttttgtgcagaaactttctatttttacctctcataagtgtcctgtgggttctttccatgtcactgtgatgtgtgtgcgtatgtgagattcaagttcagcttgctaatcttgtagaaagaattacgctccacttcccctgtgctctggccctccctaacacagcagcccatccctggaggctgatggagcccctcgagcacttctgcttaccatttctctttgttctgtttgttcaggttttctgcctcctgctaagccaatttatacattccaagaaaatcttccatttcatccaggtgaaacagaacctactggaatgaagctggcctcccgtctccttgatttgaagcagcttctccacattggttattatgccatttttctaaatctaacgttttaaaatttgtgcctttcctttctcttttgcttgacttcccagaggtttttttaaccgtcttttcaaagaagtggttttgggttttatttatcaagtctacttttattatggctgttttaaaattaaatatatttatttcttgtttcccttaaaaaagcttcttgtatgtttacttagtttatataattttatatgtcttttgttgaagcatattaacaaacacttgcagctataacatttcccctgggaactgctttggacatatccaaagattttgataagtcacacacttattgtagtttgtttctgaaaagtttttcattttagtttttattttctcttttattcaaattatcatgcgctttctccttttatcctgtttctgacaaattaatctaaggatataaatctctccctaaatgtcaattttgttgagtttcataattttaatatgtaataccctattgctattgagttccaggcattttataattttcattgtgaaaactaactttgtttccaaaacacactttttcttttttttgagacagagtctcactctgtcgctcaggatggagtgcaatagcacaatctcagctcgctgcaacctctgcctcctaagtttaggtgattttgttgcctcagcctccctagtagctgggtttacaggctcttgccactatgcctggctaattttttgtatttttagtagagacagggtttcgtcatgttgcccaggctggtcttgatctcctgaccttgggtgatccacctgcttcagcctctcaaagtgctgggattacaggcatgagccaccatgcctggccccaaaatgcacttttaacatggtctttgttactgcatgtttctaattttgttgctccctggtgagagaatgtgatttgtataacagcaattctgggaaaggggctgaagcttcctgctcctttagcacagctaattttcccaaacgctgtccatgagcttggaaagagcattgtactctgttgggatgggctcaaatctctctgtaaaaatgagtgttcttctgttgttattgttttggtttttgtttgttttgttttgttttttgtctcacttgttttgtttgctcagatcttttgatgatctggataatcttttaatttatgcaggatgtttctctgcttgtgcaggctggtgggatgggggactggatagaggacaggtgtctgcttgcccaggactggcaaactgtcacttgccctggttgtgccttgccaggagctcccgtgcctgtctctgagagtgtcatgagctcagtggtggtagttgtgtggtggatgcacttccccctgggttggggggtgggtggctggtcctaactgtttgttgttgcagatgagacacgggcgcacttctgcttcctgatggatcttgtcagtcgtttgacttcttcctggtctgggctcctgagttggccctctgcaggccaagcaggaatggagctggctgctacaagagttccttcactagagggcatctctcctctctcctcccacacatgggaacacgcgggtgggctttcctccgcccactgtggtccacagcccggctttccactcctcaccctctgctctcagacagacctgcttttccctggtgtctgtgagaggtgattcttcattgtgccaagaatgtggatttttttgagagcagggactctcacagatatttgcacacccatgttcaaagcagcatgattcacaagagtcaaaaggtagaagcattctgagggtctatgggtgagtggatggacaagcgaaatgtggttatgcatacagtagactgttactgaacctttagcaggaaggagattctttttttttctttctttttgtggagaatggggtctcgctatattgcccaggcaggtctcgaactcctgggttcaagctatcttcccacctctgcctccctaacagctgggataataggcatgagcctataatatcacccggccaggagggaaattctgagaggcatgccaacacgcatgagccttgaggacattgtgctagatggaataagccaaccacaaaaggacagatacattgcgatttcacttacatgaggggcccagaatgggcaaattcagagacagaaagagcaatggtaacaaaaggagggagctggtgttcaatgggttcaatgctcagtggtgttcaatgggtatggtttccttttgggaagatgaaaaggttctggagatggacggtggtaggggatatgcgaaaatgtgagtgcacttaatgccagttaacccacactaaaagatggtacaactgtgcattttatgttaggtatattttcaccacaattaaaaaatttgaaaagagcttggattttggagctgatctgcctgtttcagatcctgccatgaagttctacgagcttgagccagttcctgggcctcctggtgcctcagtcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcagtctaccgggagaggccaggccaagcgcttgttcacccgcagccctcttagggaactttcacatgcttctcccactaggcctaggcacccctccccaccctccctgccctcctggttccctgatcctcagtgaccttgtccttcaagactgaactccagagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcgggtcaggcgtagggtgggcccgctgccctcacacccgccccggccgcacacaggaggcgcgatcagcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccaggctcgagggagagggagtgtgcgtgcgtgtgaacgcgtcacactcttgtgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgtttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtgtgtttgcatgaacacatctgtgtatgcacgagtgtgtgcacatctgtatgtggctgtgtaagtccgtatgtacatttgtgtgcatgtctgtgtgtgcatatgtttgtacgtgtgtgtgctgtgcatgtgtgtgttaaggccctggggtggagctgagttgttgaggggagatgctgggagggcagccagcaccaggtgtttgttggccaggagagaagctgccatccaggtgcactctggggctcctgcttcagtggcacaaggcttcgggattgaggaagctgggggctggagcagggcagtcctgcacctcatgggaggtgcagagtgaggtcaggaggatggagagagtgccagagaatggggggaatctgaggcatcaggaaaggaagacacaggccacggagagggcagctgggccctgggtgaggccggccctcaggaaggaggtgccacaggtaggggagtgcccagatggagagcccaggggtatggacccacgggtgtatgacagtgggggtactcctgaaaccgcagtattatccaacaagcagggttgggacaactagttatttcatttaaaaaaacaggtcaatgtcagtcctcattctatgctttaaaataagctccagatggactcatgctttacatgtaaagaagaaaaggcaaaaagaaaataaagaaaaggcttgtaagcaggtagttaattgggggcaatcccaggatgcaggagagaggggatggagccacagcaggtctggggaagggagaaaagccggccccgagaccagggcccaaggacccattcaggccagcagtgccttctgtgcacttccgcaaggtcacacgttcttccaaagttgccatcatggagaggtaggcttccacgtagtcttgactccactcgatttcaatccttgggtggcttttcctgtgatcacactcagccctgatacagccattgctggggcctcccctggctggacgttccgcttttggtccacattctttcctcctgccctgaggctggccatgggcctcctgaaggctagctgggaggacctcccttccatggctgtgctcttgctctgcccacgctgtcgcctccatctctacctccctttccatcctcaccaccagcgctcgagtcagtggggagcttttcactcaccaagcccaggcaggtgcgtcacgtgaatttctcttgagcctcccactagaggtagtggcactgttgtcaccctatctgctgaggatatgctggggctggcaggggctacccaagaccaaaggtgtcgctgtctccatcctgtgcccacccagccctgccccctgggatcccttcaaatctttttttttttttttttttttgagatggagtcctgctctgtctcccagcctggagtgcagtggcgtgatctcagctcactgcaatctccgcctcccgggttcaagcgattctcctgcctcagcctcacaagtagctgggactacaggcacccaccaccacacccggctaattttttttttttttttttgtattttagtagagacggggtttcactatgttggccaggctggtcttgaactcctgacctcatgatccccctgccacagcctcccaaagtgctgggattacaggcatgagccaccacacctggcccccttcaaatcttaacagagaagccaccaaagtctccttgggtccatcacatggatggacctcctgggcccttcagcccctgggcttcccttgaggtcctggagctatgtgggctccagctctgggaaggtggacccccacgtgtgtgtcctgccgtcactgtctctaaggagtctggctcacactaagtgagccataaggccttgttcaaggtcatctgtcccactgatttcagacgcatggtggagtctgaaatcatctgtcccccacagtgcattcagagccctgtctggactagggcacacacacatgcatgctcatatatgcatatgcacatacgcacacacatatgcatatgcacatacgcacacacatatgcatatgcacatacgcacacacatatgcatatgcacatacgcacacacatatgcatatgcacatatgcacacacatatgcatatgcacacacatgcaaggctgcaaggctcatgcacacacacacatgcacacacatgcacacacatgcacatgcacacacatgcacatgcatgctcacatgtacaggcactcatgcacctagagccttctcatccttcactttgagtcccccctccccttgcccatccttgcccatccttcaagggctcagtcaaaagccatcttttacaaattgtctctggttgactttcttttttttcccctcttagaagaagcgatgctgtcctcagtcatcgagcattcactgggcgcttcatgtgtgccaggccccgacatgggtcttgggcatgttccagttctcatgtcctcagggctccttggtgagtcgagggtgaggaggacacggaggcacaggaggccacggggcaggtctaggtccactcagcctccagagttcagccctccctgctgagtcggggtgagcaggacagatgcctgctcctggaacttggtgggtgaggtggacaggcatgcagggaggcgccaggctcaggggctgtggaacagagaaaggaagcttccaggacatcaaacaattcctggagtgccagggcaagaggggaatctgggtggaggaaaacgtgaacagggcagaggttggaggtggatgtggcccccgagcacgttggaggcgactgaggtgcttcttgactttgggcatcttcgttcatccctgcatttgcacatttgttgaacacacctactgagacacttgttttctttccatggtccatacattaggaacatagagttagcttcctggggaactttttaagaagtattcttagagaagaaaccaggaggcatcgttgtgggatgttggtccaggatcttgggtgtgtcctttggtcttttgtgggtcaggttagcaggaattgtgtcctgaggtgttgggactgcaaagtacaggttccctcctgcccacactgatgccttcagggaatgacctgtctgctcttctaagaagaacacttaactcagccttggctgacctcagctacctgtgctttcttcagccaggctctgtgttttgtgcttttactctcaaaacaaccctattattatccctgtcccacagacgagatgctgagcccctgagaggctcagtaggtgcctgaaggtcttccagccaggaggtggcagagccagggccggcctggcctgaggactccgaagctcccatgggcacagctccttcatgccagctctgtgttgggattttctgtggttgtcacagccatcttcctggtcagctaagttacagacagggtgaaactaggatggccgagctggaaccagagctcattcctgagcagggcacctgggccctgcctacggtgctgggcaggctcctggtgtggaggtcaggctcagatcctgcagtccctgtggccgtggggcttttctaggcaccctcctgactgctaacaccaggagggcctatgatatgggaccgctgccccatgacgtgtgccaggtttctgcacgtgaccactgggaaaggctggccctgggctgggtggatccgcactgcctgctggcccctgcacccagatggtgcagcccacacccctctgatgcccacccacgcccggctctgggacttccctccttccgctgtgtctgaccctggttgcccttgttctgccactggcttgtagcagcccttccggaagccatgtcctccagggagatttgattatgtcctggtggtgcgacctcgctaatgcaatcaggaagttttctcaagacttcagctgctttgttggcagccaggcctggctctcagcagctctgcaggctggaagggcccaagagacccttcacccacccggtgtctccagcagcagggaggggtccggggcacagcctattgctgctctgctctcctcccttcttggggtaagctcctttgctctgattttatttggaatcatcgagagcctctatctgtctagaaaaagcgcttagcaatgaggaatcagcactgcagagaatactccagaaagcagccattttccatcaagattaggctcttaattgaaaattttaagaggagaggaaattaggggagaatccagatattctctccattatggtaatcagctgtaatcagagcctgagagctgtactcaatcccgggggttctcccaggattaccagagctgccacagtcaccttcaccgacctgcactggagtcagtgggaggggctggcggggtcaggggcactctggcaagtggatccaggagggctgggctggatccagggggctgagttcagagggaactctgcttagcaagtgtgaaacacaggactgggccttccaggcagagggaagattgagaactgcggctgagcgagtgcgtccaggggccccagtttagttgagggtctaagttttcccagcagggcaaggttgagggtgaggatgctgcaggccagttttctatggcctcagagtgaggacaagaagggggagatgggccacagggatgagggtgcctgctccctgcagcagggtgcacatcatggctgtgcagaggcagcaggcggcaggtattaggaagaagcccttcccgtgtgtgtcctaggggctgggcacaggctgggcacaaccctttgctcacggttgcagaagcccatccacatggggtcctgctgaactggcttcgtggggctgggaaggactggcctggcctctttgctcacttcaccttatgggcagtgtcctgcaggtttctgtgagcagagcagacagaaaggagatgcccagtgacgccagctgtcccccgcagagcttcctggagcctgggctctaggctgagggtccttgaacagacgtcatctccctggcttcagcagaatcacccacaaacccaccctgtgcccaccctcccatcacagagagcagctgctggagaacaaggcatgagactttggagacctggaggagcaggagacacaggagacaatggccagggtggtcatggtggcacggctatgccatcactgatttctgcccacccgccccctaagtctcacttgctgctactctcaatttcctacttaatgcttcggagagcaccagtcctgagatgagaggcgggatgttcactctctgggagttgagatggaacccaggcagttagaaaaaagtgccacaaccacgtgccggacctactacttgccaggagcttcgtgagtcatccaattcctaaaacaattgtgctgcgtatgctccaccacgcctgggcgactcggggaaatggggctgcgggaggctcagtgacctgccctgggtgacacggatagcgtggatgccctgtccatgcatggggctgtgctaggaggacaggaccatccccggaagctggtcctgtgtccactgctcacggtggcagctgcttgggctgacaaccgcccctccctcctgctggtgagtccttggatgtattcaggcacatggcagcaaggtctcctgtgtcccagaggcgactaggacccacaagtgagcagcaggtgccccactccttcatgctaaggctcatcacgggacgaaacccaaggtggtattggagccaggggctgtggccatgacagccacccactccagacgatatccacattcggaatagttcagagtggcctgccttgatgacatcacgaacttctccatggaaatgtgtcacagaaccagaacttaagggcatttggatgaggttgaggtgagatcaggtcacagaagaacgttctcaagttaggtgggaaacagctggagactctgggatgtcctcaggacctttatctaagcaaacacatgataaggtctttcccaagaaataagcgtggctttttgtcctggttgaggagggttgttgtggatcttttcccccttttaccttggcttccaggaagctcagtgccaagttttatgctccacccaggcctactatccttggactggtcctcaggtgcagcccttggtctctcctttctttatcgcatgagcccgcttggtttctgtacattttgtccgctggtgctgacggctggacaccctttcctgaaggagatggggcatagagtgagtggatgatgatgggctgtgacagggcccactaccaaggatgtgggctacgaggtgtgggctgggaaggaggaggaggaccctgcacctcagggggcaaccaggagcacattctggggagcacacacctgcggtgttatcacggccactgcccatgtcttggacactggaataaacaggatgtggcgaagccttctgtgtatgggggaagacttccttactcgccactgctgtcacgctctatggccatcttgacccatcactcaggcaacatcagacgcgtctctctgttcaagggctctgcccctaaccttgtgccagaaagaggcttgacagtttgtcctgtctcgaggtttcctctatatctcttgctggggctcccatagactgttctgatttttactgatgaagacagtgccatggtgagcctagcagtgcacacagctcttctctttcccaatcatttccatgggcgaacccctgagtgtagaatgaccactccagtcagattgtgaatacagtgaactgtgggccatgggctcccaggacactgctccggcctggctcctgcacccagactcattgctgttggctttgccatggtaacactagtttggtataaaactgcaccgtctccttctgtctgagtttccttgactgctgtggtggttgagcagttcgccctactttgggttttggtcttggtttcgttgcttttagtatttcacccatgaaagatctattcatacccatcacgcatctatctatccagaatttgaattcgttaaaatgcaagggaatttttaatatataataatgttagcaattggtctgtcatatttgatacaagcatctttctggcctgtttccatcttacttttgtttctttttcatccactcataagttcagactgttttctagtcagtcacggccctggttccactaaggaggggaatgtcccttgagtccccggctggcctccctgggagagtgccacacccccacccgagtccagaggctcaggagctgctctggctgcacgtgttccccgggacaggtcttgggcactggggggtctgtgcctggacactggcattttgcttcattcccactcagggcccctccgcagcaggcttggtagctgggggtggccggacacctggagaagggctgggggcactgcaccagtctcccaggctggaggggccacagtagggagttcccagctcagccccaggggatggccacccctgaatcctcaccgaaggcatccaggctgtcccagatcctgcccacacctgagacctcggctcccgcttctctccgcaggcaggcagagcaggcggcgggatgtgtgggttgaaccctgatggcaatgggaagggtcttcgtgacacagcttcccagcacccaggcagagacaggaggctgggctgctaacccgactggaggctgtgctcacccagtcccctccctgtgcttctggggtctccagaccaccccacagggtacccagatcagtgtgggctcagccccctgcccactgcaccctccttcggggtgccttcctcgtctgtcatgatgttcctgatcctgcacccgtcccctcttcctccagccttccctggctggctgctgtagtcagtctctagggctctgcacagcacttcctggtggtgcatcctggaggacttcccggtagaggtgtctggcaggcacaagcttgctgtgtgcctggcctgcagaaatgcacggtaggcatgcatttgttggatggttgtaacactgactctgggaggtggactgaggttccttatgggtccttctagcatcccctctccccttcagagatgagtgttgaaatttggggttctctgggtgtggcaggaggctggggggtgctccgctcatggccacttcatggcgggcttgggcacagttcggaaggcagccagctgtgtgtcccctgtctccggcctccttgtgtatgagtcaccattgggaagtcgccggcatttgttttaatttaacaggacttggctcatccccggagctctgccactggctcgtccttccttccactgtggagaggaagggggtggggtgcagagtgcttgcaagaaagcactttcccctcatcatctcaaaaaaaatttcttagcagaagcaatgagagaaatttactggcctgtcacaaagagtcactgctcatcagacgagagaaaggaaaagcagaggtcatcaattcatgggcagtgtctcaggaagggattaaatcatttagagacacgtccttaagaaatcattgaaggctcatgctgctgttttctttcctggccttcccatcgcatgcagatggcccctgtccagctgttcagatgctgcaccagcaccattctttttggaaatttgggcagacctcgtgtgtgtatgtgtatgtgcgtgtgtgtgtaatacacgctcatgtgcctacaaattgttatctgtgtgatatggttacataaacacacacaactgttgtctagccatgatggtttcagttttcttgtatttgtgttatgttgcgagctgctaccaattcattcagataaataagggcagaaataaatataacccgccagctacaggatgctggaaagctggttagagtccttggggggtggggtatggggggtgggggtggtctctgtcaccgcagtgccatgcagcgcctggcacggtggcgtcctcgctcctgtcatgagacagtgggaagccataaggcgcctggggctggcgcatcccttgggtcactgcacagtggtggggagctttagctgggatgccagctgggcctgggttcaggtcccagctccccactagtgacctgtgtggccagctgtcctcaaccttcagggctgtgtgagcctgaaacatgtggtgctgcatctggcatttagattgatgtgtgagggtccttttggtcattcgtgtgcctgctgctcaggtgcctgactcagcaggacagcccataggtcccagcatgacagcaggcatggggcatgaggtgggcataactaagatgttatgctggttaatttatgtgtcaacctgatggggccctggggtgcccaggtcagatatgattccgggtgtctgtgaggacatttctggatgagattagtgtcggaatcagctgcctgagtaatgcagacccttcccatgcggttggggagcatccactctgctcacggcctggagagaacagaaaggccaaggaaggaggacacctgccctttgagctggggcatgggtcctctcctgtccctggactggggttcacaccatgggctcccctggttctcaggccctcggactcagactgaagccaaacaatggctccccaggctccagcatgcagacagcgggtcctgggacttcttggcctccacagttctgtgagacagttcccatgacaaatctgtgccatggacctgggtgtctcctacaggttctgttcctctggaagaccccaacacacacatgaaggtggtggacacagcccagccagttgtgaaaaacaaacaagacagacagataagaggtctctgttggaattaaatagaagactttccaagcactaatctcctccttttgctcatcctagaaactgtggctgagcacccccctgcaccagccctgtgtccaaggatcactgatggatcccctgccctgcccagctcagtccaggggcggtgcttgcgttcttgggggatgaatagagatgctcagaggccaactgcagggccatgcctgggggctggatggtgctcccctgtctagggcactcagctgcatagggtgctcctctgcatagggtgctcccctgcatacagtgctcgcctgcatggggtgctcagctgcataggatgcttggctgcatacggctctcaactgcatagggtgctcccctgcatagggtgccccccagcatgggcacctgggtgggtccagagccatgtggctgccaccctctccctgtggaagggacccagtgaggagagctcagcaagaccacataacagaagggggttggagaggtgccagcctctgccaggaagcctcagtgcacagagcagccatggctgggctgatagactcatcttcagtcttattgccttcttacgggagacacagaggcagagatcatgcagggcagggtgaggagggcccaagcttttctcagggcctagggcccggagcatggccctcctgcccacccaccccggagtgccttcctgtctcttcacatgatattagcttccctcaccatcttctggtcccccagcagtgtcacctgaggcctgcctggagctatgtcaggagtatcaaccgcactgagagcttggtgagcaattcatagccttgcccagtgggagtctgagcatcccctgtggccacctgagtggatgtcaagtggggctgccctgcccccagcccatgcttgaccccgggatcctgagcagattcctggggcaggttctgccttccttccctggggctgtgtctctgtcactgctcaggagtgacagtgcctggacatgctccttgggcttctggggtgttggtgggtggtccaatggcagggacagaggagcagtgtccttgggatggccagaggcatcctcctatggataaagtcggtggccgatggctggagggctgactgcgggcctgctggggccctgctcactcactgcagtggaacaggagcccccgatgcagccccatcctcagcccagccaggggtgggagggagaggacagggcccttcgatgcacacccttttcccgtcccggagagaggggaggccgctgcatcatggcgcaccctcctggggcttgggtgaatgagtgcttactgctctttggagaggcaggtgacccatctgctttctgcattggttacgcagccccacacaatgcctggggactcagggcaggtcctgaaggtattgggcttctcttctgtccttctcactcccccagagagactgggggttgagtgtagccatagccagcccccctttcatgataatcagatgggctctgagtggagaccactggggctgcaggcacttatgagatgaggatgcagagataaagcccatggtcccttctctgcaggggccagagcccacagttgtgcagagaagggataaagccaggggagcacacgagcccccggcccacctgggagggcccagcaggctccccgagtgagccctggggtaggatgggcagcctggaggggaagaggctgaaggggccacagaccagcctgggcatagagcaggctgcaggtgaccagctcgtccctctgcccggaacctacctgggaaagtgcccatcccagcccaaatgggacggctactcccctggtgggaggcagggtgtgggactaaggggagatgctcagatggcgacaagccacctggagcttagacttggacctatggggtgtggaccaaggaaaggttgggggctccaggcctgggctatgcctggaaggacgatgggcaggggagatggggtccatcaggggcttctttgatgcaggcacagagtcggagccgggcttccggggagtacacaccctgaaaggtgtggagggggcaggatcagggactcggcgctggatggtgttggggtgaggcaaggcttggcccaggtcccggctctgcatctgggtaggtggctgtaggtgggcaactgctcctcatgggaagctgaccatctctgtgccgggctggcggacaggaggtgtccagaacagggcagggctgaagtgcagggggcccaggctggagactccccgattggagggcccccagtgaggggtcatcgaaagcaaagagtgcccctcagtgctcagggctaaaagggccaggtccaggactgctggaggagggcccaagaagtgggtcagggctcagacgccaagaagggaggggggcacagggcagggcaccatcagggccaggaagggacaaggggggccagggtccttcagatttgccagtcagcgttccatgaggagacaagcgtgagccagcaagacggtgggcatggccggtggttctccaaggcttcctcagggcacgcggtgggctgtgtggggtgtcacgtgagaaacggcactgagattagtaggcgtgacaaagctgaattcctcacaaccgctcccctcagggcccaccacgggctcctgcaagggcggggaatgcaggtgctgggccccgcgggaggagcagccacagcgggggacagggaggccagagccgagtggagaggagtgcgggactgaggaggcttttatcccccgaccttttctgaagagagaagagatagaagcagagtcatgagtgctagagacgggcagggaaggaaatggattaaaggagctggaggagagggtcccggagtgtacggaggagtgagaccctggccccaccgcctccctgggtgtgcgagtgggagtgtccaggcatgcatgtgcgtgtgggtgtgcgagggtgagtgtgcgagtctgggtacacgcgtgtgtggtagggagtacaggtgggggctggcgcagtgagaggtgggggctggacgaggcaagggtgagggccccttggtcagggccgcccactgcccgcagaagcccagggcagtgaaggcgcccaggagcaggtggttgggttgactcaggttggagaccccgctgggggtcagcagaagaatgaggggtggtgaggggcgctccaggcagggtggtgaggtagagagaagagaggcctttgcattttgcgtattctgttggtggaggaaatggtgagccatcaagggctgctggcagcctccccctaaaccagcccaggaaatgctggaagagagagactcagagcaaatatagacccacagggatgcctggagcacagacagggtcaggttcaggttgctggggaggccatggcacaggtggaggacagctggaagcctccacgtggtgctggccccctcctgctccctgggctgagccagcccaaggggcacgcaacctctgagctggcagtggccgctctgcccctggctacagcaggtatcagagcaggcagttcagacccaacacaaaacccaaacatgcctgcaggagcagctcccagttgcgcccagctcctaaagaacacacctgtgccatagaagacagacagagcaggacttagaacaagtgaccaaagtcctcagaggacttcgtcgtaagggagcatgcaatgaacatgagctcaaaagaagcggctgtcatgacaaaccagttggggatgttgggtgtaaaaaacataatttatagatagaatagaattcattaatataatgtatgaaactgtaatataattctaaataaatataattgttgaaaggggctagaagattttaccaagggactccccagaaagcatcaggagggtataaggaggtgggaggcaggttgagaggtgaggaaggtggaacaagacggcccctgcccgtctccaaggagtcctgggaagaaaggaagaataccgggtaggagaatatatttgaagaagggttggcagagaatttccaagaactaaatacagacacaagactttagatggaagtgttcacagagtggcaagcacacacaccagaaaaattagaatcacagagggaaaaacagttacagagatacaagagtgagtctgacctcagagttctcaaggcccgacagaaggcaggagaccaagtcaccaggtcagtggggagcatggacaggaggtgtgaagtgggcatagctaaataacgagaaggatcgaattggaatttcagcccaatataccattagtgtacaccactaacacccacataaatgatgctttgtatttttcttatctacaaatacatggaaatacagctgacccttaaacaatgtgggggctaggggcactgaaccccctcacagttgaaaatttgcatataacttttgacctcctcaaaacgtaactattaatagtctactgttcactgaaaccttactaataacacatacagtcaatgaacacatgttttgtaggttatatgtattatattctgtattcttttttattttattttttgttgtttacccacactacacagatgtatcacatgctatattcttcaatgaagtaggctagagaaaagaaagtggtattgagaaaataataagccagagaaatttatttactcattaagtggaagtggagcattgtaaaggtcttcatcctcatcttaagcaggctgaggaggaggaggaggaagggaaggggttggtcttgctttctcaggggtgtcagaggcagaagaaaatctgtgtgtaactggatgtgtgtggttcaaacccatgttgttcaagggtcagctgtaagtaagtaagtggcatgtggcctggagaggtaccacatatatggggaggctgctgatgttaagtgtgtgaggaaggagatagggacacgggagaaggggttagaccaacacaacagtatcaggggctgaagtggggccctcacagacagatgaaaaggagggggaagggaggcaccctgccaactggggaccacatagctttgtgcatctgaaagccactgaaaacagggaaattttatcacctctagacctgtagggagggaaaggaaataaggaaacacagtccactggggaccaagaaaaaagtggtggaaagaaaataagatggtaaaagtcattcaaaatatccttaagacagtaaaatgtaatgatgttacaggaccaccaggttcctacacctgctgcgcagttacagaccaatgcaccaagacagcaggctttgcagcagagaaagagtttcctgatctcagggcagctgagtgaggaggcaggagggaccctcacttcatctctctgaggagttttgggctggagtttttaaaggatcgtggaggtcaaggggtggaaaattggggccactgattggtggggctaaagaggatgcaatcatcggggtgtggacactgtatgttctggtgagtcagctgcttgtggggtccctcagaccagatggaatcagctgtttgattggtatgcaggacctagaaggatatctcaagtggacaacttaacacttcacaatgttcaagttgctatctatagaggatagttgttatctatctgaacttaggggaactggggccttgtaacggattacaaggtgattctgaggcagtatgcatggaatggtagtgaggaagggtcagagagcaagctggcctagaagccaacactcaggacactgcaagcttggtttattttcctttctctccctcccttctttcctaattaattttataaaacgtatagggatggattcaataagattaaactcatctattcgaaacatggattctcaggctgtgtttttttacatttttgttttgttttgttttgtttttaaagcaagctatctgctatgaagtgttaacagaaaggaagtgggtgtgggaagcgaccagtaaggcagggagaggtgcatggggtggggtggagggcagtaccaggtaacttggaaggaggtcatgcacctggaagatgcagccaccagcctcagtgagacaacagcaaacctagcatgtccccaggcatggtgggaactttgaacatacctcactctaaaatttgcatcaaacagaataaaaatcatgaaaataaatagatctgaaatacagattttaagtttgggctgctgggcagatacagaatcctgtaccccatgcgccgggcattaacattttttccagcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcaggtaaaatggcactagagggaaatttataaccttaagtgctgtgttagagaacaagatagaaggcaaattaatgagctctgcgttcaacagcagatgttaggaaaagaggcacagaacaggctcagggaagaggccgaaggcagagccgggctggagaaggagagctcagggaggctaagagcagtggcctggggaaggggcctggggccgtgggtcaaggatggagtcctgttgggagtgtggggagtgggtcagggatgctggattcagcatttgaggatgggctgtgctgtgtggatgaaccatcaagatagacatcaggccccccagaatttggcaagactggaggtagagccaagtgaatccacgccagagtcctggattactatgggccatggcagtggtgtggagagaccactcagacctaatgagcctgcaagactgtgggttccgtctgcttacaggggagagctgggatttaagggaacaaaagccttggggaaagggagcgggctgctcaggggaagtggatatcagtgaaagccaggttttgtttaaggtgagatgtccgtgcaagttgagtggaggggtcatggggcacctgtttctctgagtccccagggggcagggagagggatgggttagggctgggtggggaccagggtggctggtggtggtggttatacccaagcacagcagggttgagactgacaagctcatccagcttctgaatcctgatggaggccccagagcctggtgccctggggactctgcggagggtggtgcaggagcacggccctcaggtgctgggagtgaggtgagcagggtcaccccacacctggcctgcccctcctcccttgaaaccagcggtgtgtctgagcactgggcctgaaagcatggcatctggaggcccaaggctaatgcccatggcctcctctgcctgctctgcttgtccaggggctgagctgtcctggtctctccctctgctccttcatgcagaggtcttcagagcaccctaatgtgtccaatcaaggccaggcttgttggtgagacactctcggtccccagctccatgctagatgtctccaccctcaaaggacccagcatctcatgacttcatgtcccactagcagtccctgtgcccagttcacccatccccactgaccaccaatgtttgatttttccttcagaagcatgtgaggaaatggattgttgattagcctgattcaatcattctacattgtaaacatatcaaagcatcaccttgtatcccataaatgtatacaattattatttgtcaataaaaaataaaattaaaaaagattcagttcccagctgcctcctccaggaagcgtgcagcactctcccttgctgaggaccaactttacaccagttcttaccctggaccctgcagagggcagagggcacttgggctgcccatcagggacacatccatgcctctctagctttctaggaagcttcctgtctcagcccaggactttgggaaggtggaggtagtcacctcctacagtcaggacagctgcagttcagagggaagaggcacaaagtcctcaggttgaagttacccagctggaatttcctttctcccactgaaagaggatggtgatatttgggactcagggttgatgtcaccatgggaggtctactgggacagatgctgggatgttgagctcatgcctgcagctgtacacagtgggcagtgtggctgtggctctgggcacctctttccttggtgccagatgtgctgcctggccctgtatgtaggaggctggacctgctgggccttgtggcagggcctcagggtccttctggtcacctcttcctccctgcaggtgcctctgcttttgagaaactcaaagccaaggacaggtcactggatgtgctgggggcaccaggactggtggggtagggggtccttggtgccaagttcaccccaacctcagcagggagaaggggctttggaaaggccctggcccagggagggggcggccaagcaggcctggctggggaggcccaggcattgcagttgggccaggggcccgtgtgagggaggcagcctccccttctctaggatggggccagtgcccagctctgcgagacccgtgtcctgcaccccacaccccagtggagcacagcatgaggccctcaggcccgatcccgtggttgctggttctgcgaggagattttgaatccccactagattgtcttaaggttcataggcatttttgggttttctatgtctttttcagacacgttccaagtttggtctcttcaggttactgtctgttttgtcagttattggcagaataatgttgtatagtaatttgtaaaatgtctgttatatttaaagttatgtctccatttgatttattgtgttatatgctgtgccatccctcttttcattttcttggtcaattattctagaggttggtttacttttattagtattttcaaagaatcaccattttaattttgttgaccctttctttttttaatttttaattttcgtgggtacattttagtaggtgtatatatttatggggtatgtgagatattttgatacaggcatgcagtacacaataatcacatcggctgggtgtggtggttcacgcttgtaatcccagcactttgggaggtcgaggcaggtggatcacaaagtcaggagtttgagaccagcttggtcaacatggtgaaacaccgtctctactaaaaatacaaaaaattagctgggcatggtggtgggcacctgtaatcccagctacttgggaggctgaggcaggagaatcacttgaacccaggaggcagaggttgcagtgagccgagattgtgccactgcactccaacctgggcaacagtgcgagactccatctaaaaaataaaaataaaatcacatcagggtgaatgggttattcatcccctcaagcatttatcctttgtgttataaacaatccaattatactcttagttatttttaaatatacaattgaattactattgactacagtcaccctgttgtactaaatagtaggtcttattcattctttctaactactttgtttgtacctatttatcttcatcatttctcttactcccctactacccttcccagactctggtgaccatccttctactctcttcctcaataagttcaagtgttttaattttcagcttccacaaataagtgagaacatgtgaagtttgtctttctgtgcctggcttacttcacttaacataatgacctccagttccatccatgttgttgcaaatgacaggatctcattcttttttatggctgaacagtactccattgtgtacatgtactacatttgctttatccattcatctgttgacggacacttaggttgcttccaaatcttggctattgtgaacagtgctgaaaacacaggaatgcggctatctcttttgatatactaattttctttcttttgggtatatacctagcagtgggattcctggattgtatggtaactctatttttagttttttgaggaacctccaaactgttctctatagtgattgtactaatttatattcccatcaaaagtagacaagggttctgttttcttcacattcttgccagcatttgttattgcctgtcttttggataaaagccattttaactggggtgagatgatatctcgttgtagctttgatttgaatttctctgagatcaatgatgttgactccttttcatatgctgttttgccatttgtatgtcttcttttgagaaatgcctattcaaatctatgctgagacacctggagctggaggtgggatgacacaagcacccctgtggctgccaccactaggattgtgctgggccaaacctgaaaccagcacagcactgggtctcacccagggcccattgtaaccactacctggctattacctatgtttgcttaaggccctagagctctgcaatcagtaggggtgaagccagccaggcttgtgtccttcccttcaggatggcaagttcccccaagccctggacaggtctagatacactgtctgggagccagtgactggagtcaagaaccttagaaatctgcttgatgctttattctactgcaggtaagccagcactcaaatcacaagacaaagtcctcacttttctctctgctttccacagaaagaggagcctctcccatggtcatggccaccacaggcctacatgggatactgccaggctaccaccaatgttcactttaagcccaagcgcccttcagtcagcttatggtcaatgctgccaggcctggtagtcacccttcagggcagtgggctcccctctggcccaaggcaggtccagaaatgtcatccaagagccaaggcctttggaatcagggatcccaggagcctgcttggtgctctgctccactgaactgagctggtacataaggtgcaagactaagtcccctttactttcccctctgcttttctcaagcagaagcagtctcttaccataaccaccatagctgggaatgtgctggttctcccctgaagccagcatgtctcagagtctcacccaaggcacatggcatactacctggatatcactactggttcttcaggacccaagggctctttagtcagcaggtgatgaatcctgccaggactcggtccttcccttcaaggcagtgggttcctttctggcccaaggtgtgtctagaaatgtcatccaagagctagggctcaaaatgagggccttatgaccctgaacagtgccctattctgtggctgagctggtatccaagacacaagacaaagttctctttagttccctctcccctccttaagtggaggaaagaagtcgctttcgttgctgtgagctgtgctgcctagggctgagggaaaaatagcacaagcatgccctcagccagcccagctggtgcctcactaggtcacatgcctcccacatccactggctctgagcccagcacggcactaggacttgcctgggaattgcagtccttgtggcctagattgactttcaagtctatttaggaccccagagcctttgagcccacagtggtggggcttgcaaaaacttatgttccaaccattgggatggatgatgatgcccctctgtctagggctggtctaaatgcttcctctgtgggtgggtgtcaagcaagtttagcctggtttttctttctgctctgacagagcagcacagagttcaatgcagggtcccataatcactgcactctccttcctccagtgcacagattttccatgccacaggaccactactggggagtggaggaggggtggcttcagggattcaagactgtgttttctaccttcctcggtgcctctttcagcgataggaagttaaaaccaggtactgtggttgctcacctgattgttggctcttatgaaggcttttttttgtgtatgtagatagtagttaaatttggtgttcctgcagtgggggcgataggtgaaatttctattcagccatcttgctctgctctcccttgaccctttctgttttatctttatttttccatttcattaatttttgctcaaatcttgtgcatttctatctgcaagcttatttctaaacttttattaatgtcttcatctgggctccgaatagcctttcttaataggtaaagattataaattcctgtagggtgttctagtggcagccctcaatttttgatatgtattattttatcagtgttgagttacaagcagttgcatagtatgaagtcttatgtgtctcactttttgcactcaatattttgtttgtgagatgttacatgtagccataatttatttattctcagatattatacataatctttcataaatgaatatgtcaccatttttccatctctctgtttgtggatatctggcttgtttccaatctttggatattatgaataatgctgctgtgaccatccttgtacacaactcttgaggtacatgtccatacattcatgttgattatgtatctaggaatgaaatctctggggcataggatatgcttatgttaaattctattccatgatgccaactgttttccaaattatttgtacaacatgcactttctccagcagtgtgtgagtacctacttctcctccagtcttgccaatgcttactattgtcagtttttaaagttttagccatttggcagatgtataatggcggctcaaagaggtgtgaatttacattttcctgactactaatgtggttaaacaattttgtatgtgtgtatgaattccctgctgctatggtttgaatgtcccctctaaaactcatgtggaaacttaatccccaatgtggcagtattgagaggtgggggcctttaagaggtgattgcatcatgagggctctgctcctaattcattcatggattaatgggttagtgaattaatacattatcatgagaggcaaacaggtggctttataagaagaggaagagagatctgagctagcacactagcatgctcagcccccttgccatgtgacaccttgagccaccttgggactctgcacagagtccccaccagcaggaaagctctcatcagatgtgaccccttgactttggacttctcagactccataactgtaataattaaattccttttctttatacattgcccttctttgggtaagtcctagttcaggtcctccatattcttaattattttctgtctactagttctaacagttgctgagagggagatgttgaagtctccaactataattatgaatttgtctctcctttcagctctgtcaatgtttgtttcatgtattttgaggcactgcttttggtgcatatgcctttagaattgttatgacttcctggtggatttaattatgggtatgttagagcttaagactaccattttgttatttgttttctgtttgtttcctctggttatcattcctttttctcttttattgttacttgaatacttcttagtatttcattttgacttatttatagtgtttttgagtgtatttcttcatagagtttttattttggttatttcaatagacatatgtgacttatcgcagtctgctggtatcaatgttttgccaccttgaaggacatgtggaaacctttcttccatttaggtcccttatctttctttctttcttccttttttttttttttttttttgagacagagtctcactctgtcgcccaggctgcagtgcaatgaagcgaacttccgcatcctaggttcaaacaattctcctgcctcagcctcccgagtagctggaattacaggcattcgctactacccccagctaactttttgtatttttagtagagatggtatttcactatgttggccaggctggtcttgaactcctgacctcaggtgatccacctgcctcgccctcccagagtgctgggattacaggcatgagccaccgtgcctggcccctttcacaatgttatcttgagcatcaaataatgctataatttttgttttgatcttcagattcttaaaataaaactcacatgagaaacaatggtctatggtttgtactcatatgcttcgtttttatgttgttctttcttatgctccatggctccttcttttattatttccttcctgctgaaggtcttcctttagtcaatttttaaggataggtctgaaattaacaaattcttctagctttccttcatctgagaatgtctttagtgccccttcattttggtaaaatagtcttgccagatagagattgtggttgacagttcttttctttcagcacctgaaaaatgttgtaccagttccttctggccttaaatataaaaaagatttattatgacaatatatcttttataagaggttatatcacccatggtttcaaataagaaatccactgtcaaaccaaacaccgcatattctcactcacaggtgggaattgaacaatgagaacacatggacacaggaaggggaacatcacactctggggactgttgtggggtggggggaggagggagggatagcattgggagatatacctaattctagatgatgagttagtgggtgcagcacaccagcatggcacatgtatacatatgtaactaacctgcacattgtgcacatgtaccctaaaacttaaagtataataataataataataaaaagaaagagtaaaaaaaaagaaaaagaaaaaaaagaaatccactgtcattcaaatggcacttgtaggtaaaatgacatttttttttctggttgttttcaatattattgtctttagttttaataagctcaattatgatgtgtcttcattattacatatgtatagatgacctgttggccctgtttctctggagaaccctgactcttacatggtctatgagcctagaatattttgttgtgccagaaagtataggagtcctagaaaactgattagggcaaaacaaaggacccaggatccagcttgatgaggctcccactggccagatctgagataatctgagcataaaaatgaataatgacaggattgtaacccggtgactaagaacaggatacatgctatcattttaagttataaaatgaatgaatgaacattcttttttacaaggaatggtgtggaattagaaaaccaccattttgtagccaccattggaataattgattcaggcagaaaacatcaatggatgttcaaatcattagatggaagttaaatgagaaatagatttatttatatgaattactttttaattttaaaggggaaaaaaagataccattacaatgggaaaatctggcagatactaccatgatattgaatgaaggttagtaacatgagtaacaagacaaaccagcatcatgttgatgtcctgagaagaatacagcaccattcctgccagaaatgcatggcccaaatctaatcacaaaggaacatcaaactcaagtaaaacacattgtacggaacagtggcctgcactcttcaacgatgtcaaaaatcaatgttaaattagataattatattatggttatataagagaatgtccttgttttgagacacaggctgaaatgtttggaaatggttgtgatatctgcaaggtattcttaaatgttacaaagagagagagagcgcgcgcacaatagagcataggcaggacaaaaatgttacctgatgactccaggcaaagtgtttttggaggtggactgtgttactcctaaaaccaagtgtgttctgccagctcagggattctgggctgcttggatttttgaaacaaacacacactcatcagagggctgtaaacagtgcaggtgatgcctgaacacagctgactgctatcttggtttaaaaatgcagactctggagctggatggttgaatctctattacacccccaatttgtgtgatcttggtcaagttcattgacttctttaggcttcagttccctcatctgtaaaacagtatgagaatagtcgctgtgttctaagattgctttgaagattaacatgagtcggtaatatctataatgcttataagggtgcctggcacacagtaacgatgaataaatgctaattattgtatttactattagtagtaattggacaggcagcaaagaagatccttcaactttctgtctcttaatggtctgaaacttccatctgttactatttaaaagaatttgggtaagtcctcgtacagaaaatgagtctttcttaatttcggaatgatggtaaaacattgggttttagtcccaccagtattttctacctggaaaggaactgagccagctgggtgggcagtacagaaatggaaggagggagtagggaactgatcctgcttgcaaagacaaaagaacaaggagaccctggggaatgcagaacctggcaccatttttcttcaactaccatgaaaatagacagactgcctgatacggtttggctgtatccccacccaaatctcaacttggattgtgtctcccagaattcccacttgttgtaggggggaccgaggggaaggtaattgaatcatgggggctggtctttcccatgatagtgaataagtctcatgagatctgatgggtttatcaggggtttccacttttgcttcttcctcattttctcttgccaccaccacgtaagaagtacctttcacctcccaccatgattctgaggactccccagccatgtggaagtgcaagtccaattaaacctctttttcttcccagtcccaggtatgtctttatcagcagtgtgaaaacagaccaatacactgcctgacactctttgatgaatagtttttgcgtcaaagagtaaattgggagtaaaataacagaagataaaaacaaaatattttggaaccaaaagaagaatgcctaagctatgctcagtagtacattcatagttttaaatggccttaaaatttaaaagagagagtttcatgaaccattatgcttatatcttggttcttccaaagtgctgctaaagtcttagcctgctgcaatgagtacctgggcaggtatgtgaaatactccaccttggtagagataacagaaacataaccttgaccttcccattaaaactaaagggaaaattcgactgaagttttcaagtagtacccttaaggaatcacacatagaaggtactcaataaatattatagcttgaataaataaaacaatgccactgagagcctcaagggtctggagtactctcagataactggcgtattagttagatgttgctctgtaacaaaccacttcaaaacttagaagttacccagctggaaatttcctttctcccactgaagatgggagcctattttaggggcctaaaatagtaaccttttattatttctcatgagtccacaggacgatggggcacttctgctactctgggctggatgtggctgatcttaactggctcatcagtgatcagccagtggattggctgggcctggctcatctcagatgacttcagccctccttcccatgtcctgcacatcccttcagcaggctaagctgggcttgttcttatggcagtgccagaggtccaagaaatgagtgaaaatgcacatgtgcttttccaagcctctgatcccatcctgctggccaaagcatgtcacagcatcaagcccaacatcattttgggagggccctacttaaacgaatggcgagagtgatatatgaaaaattgggccaatttctgcatgaatcctctatgattgggaatcacgtagataagtgttttgggacagttcatccaaatgacagacataaaataatgaaatgtgaaatgacagacataaaataatgaaatgcgtggccatctccttaccacagttgattctaacccagttgttgaattatttgccatacctcactcagttcagcatggctatcagtatgatgcacccttctatgtctctgaggatttataagagatctaaattttttaaaaagaaagaaactggactgccatccaacagttcacaaaaatcaatttcagatatatcaaagacccagaggtaaaaagcaaaatttcaaagctttcaaaattaaatgggggtgggggaatctcttaatatccttagagtagaaaaaattctttaaaaagacacaaaatgcactatctatataggacgcattttcaaatctagccatattgaaattgatgatttttgttaatcaaaagttacctcaaagggaatgtttttaaaagtcatgatatgagataaaatatttgtagcacatgtaaccaacaagtgactagaacctgggtacataaagaactcctgtaaacagtgttgtgctggaagatgtttaacaactgactctcaggccctaaaagtccttatttttagcatttgcttgtttccaggatataaacacttccatgtggccaatttcaagccactaaggtaaggtcaccaagcagggccttggggatagatggtcgcagttggctctcacaaggcaggtataaaggctgcagcacaaaagtcaacatgaaaaacaaaacaacccaatgggggccaggcacagtggctcaagcctataatcccagcactttgggaggccgaggcgggtggatcacctgaggtccggagcttgagactagcctgaccaacatggagaaacctcatctctactaaaaatacaaaattagccagcgtgatggtgcatgcctgtagtcccagctacttgggaggctgaggaaggagaatcgcttgagcctgggaggcagaggttgtggtgagccgagatcacgccattgcactccagcctgggtgacaagagcaaaactctgagggaaaaaaaaaccaataggaaaagtgcaaaagacttcagaaggcttttatgagggctgtcttagttcatttgtgttgctgtgaagagatacttgagtgtgggtggtttataaggaaaagagttgtatttggctcaacgttctgtaggctgtgcaagaagcatggagctggcattaggcaagggcctcacgctgcttccactcatggcagaagggcaagggagcccatgtgtggagatcactcggcaagagagaaaggcaaggaggtgccaggctctctctaacaagcaggaacgaatagagtgagaactcacactccttccccatggagggcattaaagtattcatgagggatccgcccccatgacccaaacacctcccattaggccccacctccaacactgggaatcaaatttcaacatgagatttggaggagaaaaacagacaatatcaaactatagcaggggcataaaagaaaacctaaatggacaataaaaacctgaaaagatgctcaatcttgtaactgatgagggaaatgcaaattaaagccacaatcagatacatttcacaccctccagattgacagaagttaaaaagtttgtcagtttggggttggtgattcggagctgtggaagctctcacccacggctggcggagcctgtgctagtacaaaccactgtgagaagcagtttggcatttcctagaagaggtgactgtgcacaccctacaaccagcactttcattcctgtaaatgtaaacgtgccctagggaaactcttgcccatgcaccccgcaggacacacagggttcgcgggaggaccattagcaatgggaaaaaatgaaaacaacccatgtgcccatcagcaacaaaataaactataatctctgtatatgatggaatacaatttcacagcagtaaaactaatgaattgtggctacaggtatcaatatggacaaatcccaagaacttcatggagagagagagaatcacaaaagaataaacgtcacataactgcaatactataaagttccttatctatactaacaaagacaggggtgtttatcagcaaactcaatttggtggttggagagaggggcaggagagcaagaggggtatgatctgagcgtggggcaggaagaggggctaatccatgcgactggaaatagttcgttctcaaactgggtgtgagtgtggaggtgctcactgcattgttgctgctgagacatacgcttgcattggatagattcttccacgtgtgtatttcaaatttggcttcatcacaaggcttgtgggggagtgacaaagcagtgtattaagtgtgacagctgaggaaagccccagcagcaggggacagagagaggggcacatgttgtcacctggaggtggggtggttgcgggagaaacgtccaggctacaaaccgagttgcgaatcacagagggacttaggccgggaaggggcagcacggcgccctccaggcagagaagcagccccgcggccaccctgatgcggcgcggactcctcctgtccagttctctgtcacacctgctgcctgccccctcgccaacccctgcatacatggcccgcatatcagaggcggacgaagaagcggccagaacttagccagtcttccttcttcatcttccttcctcctagtaaaacacacacacacacacacacacacacacacacacacacacaaatgggcattagcctttcctctggtcgtgcctctatttcagcttgagattttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgcggctgggccttaggtcttgcccccagtttcctatgccctaggacgtccccttgggggccagccacccccagcccgcggagggaagaggggcccttccttcgcggaccgagggcggcagcctgtgtggggatacctgcgcaggtgcagccccggtgagagctccttaccaagaaagagggacattcatttccctctccaaggtagcagcgttgaaaggcttctccacagcattactcagtccaactaatgatgggaaaaggagggaaaaacgagggcgccgagccgcaaccgcttgcctacctccacctaaaacgcaaacacagcccgagtcgccagtgaccctgactcaggcggccgcgggcgttccccacggcaggacctggagccacacccgggccctcggggctccatggcagcgcggcagcgcctccttcgcggagaagccccactgccaggagaaccactgccgtcgggagacgacgtctgtatttgtagggagtgaaaggaggcgccgagtcccccacgtttcatcgcagggtcttcggggcagaattcggagacacctgtcacgatgggagcagtcagggctttcctggttttggggcctctggcttaggtgggctggcaatgcctctcctttcattcctgataaacatgctgggccggagcacagcggccatggggctgtttcttgtgagccacggctagttctaaactgtactgatttggacacctgccaccagatgagaaattagtaaaatgtggttaccaagggactgcttctctgctctagctgtgaacggggtccttagcggcctgcatgcccgcgcctctccagactgagaccaaagacttccgcgccaccgtcggcagctcgcgaacttagacttcagaccgtctgccgcactgcaataaagagaccatggtggggataccttttaaatgatttaaatgtgtccttccttctgcagcacacacacgtcctcctgaactggacacctggccaggccaacgaaaaaggagaagctcttttgtaaggtggcagggacgcacccccttagctagagacaggcttctaggtggctcgccttctactggtagaacatgtagggttatctgctaaagtgtgggacctgctacattgaagccaatcttctctgagcaggactcaatttatttttttcttaattgcaacacatgaaaattttaggtcaccaagaaacactagtcaaagggtttcattttctgtttatggcctatttattacaattcagaagaaaaatgaccaactagaaaaaaaatatgtaacacgtatcacggactgtcaaatgtctttttttttttagacaaggtctcactctgtgaccaggctagggtgcagcggtgtgatcttggctcactgcagccttgaactcccaggcttaagcaattctcccacctcagccttctgagtagctgggactatggcatgcaccaccacacctgggtaatttttgtatttttttgtagagaccagggtttcgccacgggcccaggctggatttttttctttatatgtaagaaaacttggtggagacggggtttcgctgtgttggccgggctggtctccagctcctaactgcgagtgatctgccagcctcggcctcccaaggtgcggggattgcagatggagtctcgttcactcagtgctcaatgttgcccaagctggagtgcagtggcatgatctcggctagctacaacctccacctcccagccacctgccttggcctcccaaagtgccgagattgcagcctctgccctgccgccaccccgtctgggaagtgaggagcatctctgcctggccgcccatcgtctgggatgtgaggagcccctctgcccggctgcccagtctgggaagtgaggagcgcctcttcccgggcgccatcccaactaggaagtgaggagcgtctctgcctggccgcccatcgtctgagatgtagggagcgcctctgccccatctgggatgtgaggagtgcctctgcccggctgcgaccccgtctgggaggtgaggagtgtctctgcccagcagccccgtctgagaagcgaggagcccctccgcccagcagccgccccatctgagaagtgaggagcccctccgcccggcagctgccccatctgagaagtgaggagcgtctccgcctggcagccgccccgtccgggagggaggtggggggcagacccctcccggccagcctccccgtccgggagggagttgggggccagcccctgcccggccagctgccctgtccgggagggaggtggggggcgcctctgcccggctgccccttctgggaagtgaggagcccctctgcccggccgccaccctgtctgggaggtgtacccaacagctcattgagaacgggccatgatgatgatggtggttttgtggaatagaaaagggggaaatgtgggaaaagatagggaaatcagattgttgctgtgtctgtgtagaaagaagtagacataggagactccattttgttctgtactaagaaagattcttctgccttgggatgctgttgatctatgaccttgctcccaaccctgtgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctttgttcacttatctgctgaccttccctccactattgtcctatgaccctgccaaatccccttctgggagaaacacccaagaatgatcaattaaaaaaaaaaaaaagaaaacttggcaaaggatatggacagacaggaaatccagctggatcttcagcatataaaagatgctctaccacactggtaataagaaaactatactttaaaactacaagatactattttacagtctcagataggccaagttcaaaaatgaggagagtggctcgtgtctgggaggctgtggggtctgcgcggtcactcattactctccttatgccccctggggagatggcatggcaggcagtttaccttccaaaggtaacagttcacacactctttaacaaagcaattctgctcctttgtcctacggacttgcttgcatatgaaatggcctgccagtgagaatgtgcactgcaacgtggtttccagtagcgaatatgaaaccaatctacatctccataaataagagatgggtgagatagtgatgcattcacagaaccatgagtagccatgaaaaaaatgagtgtctttatatgaactaatatgcagagatctctaagaaatattattaaaggaaatgcaaggtgcagaactgtgggtacacctaccactaatgtaaaacactaaaaagcattgtgtaaggatataaaagaggttgctcatagtgttccttccagggaaagaaaatgggatgactgtgggagaagggttggaggagatttaactttcactttcaaactttttgctgtgttcatactttgtctattcaaaaaaattaacaaataaaaatgcatttaaaaattagaggccagtattacctacagtttccagccttctgtgtaaaagcagatgtattcacattctccagagaaacagaaccactaaggtatcaatatttccatatctctatatctgtctatatatacagatttattacaaggaattggaggttgagaaatccagaccccaggcagcaaatagtggtatgtgacttgccttcatcaacagaaaatgctggaagtgatgttttggggcttacaattccagtctttagagaattgttagcttctgcttctcctcttctagagtccagacaaggtaaggtgttaaactgtactgagacagccatgctgtgaggaagcccaagttatccatatggagagagagacaacataagggagcactgaggttctagacttgtgggtggagacttattggaccctctagcctagctcagctccatatatgtagtccatgccatgaggtggagcagaagagctgcccagccatgccctgcccaaactctcaacccacagaattgtgagaaacaataaattgttgtcttaaaccactaaattttggaatgttttgttgcatagcaataggtttgcccctaacatactggatgtcacaaggtgacaattcctttacagggacagctgagtgaccatcccatgggaaacaaatatttgcattcctttatcatgttactgaggcgacatctaattgtatccttctttttaccttacgtgagacactaatgggtggttttctccttgatcttttacagaagcaaacacagcatcaaacagcaaggggcttctaataggggatttgcagatggccagcctatctcagaataggacacaaagatcttggggtaccttgtttaggattcagacagtagtccctgtgaatcctatatacttgctatgaaaaggaaaaattggcttgtcaatttgaggtcaaaatggtggataggaggcaggactagcagctcctactcagacagagcagcacgtggagattcacatcatgaactacctcaagaacataccaggaaacctgagagaatccacagaccccttgaaggaggtggattgccactgcaggctccatgggacagctgaggaaactgccagtctgtttgctttctcacctggaaggcttgtagcctggggcaagttctcagccctgctcactggctgcctggaaataaactgagtgctgttgggggaccacagtgggagtgagatcagccttttgggctgtgggctgcatggcagctgggtgacgcctgtggctgccagctttcccccccttccctggcaacctgtgtgatgcagcagaagcagctataatccccttggtaacataactccattggcctgggaaccacacctccaccccctaaagcagcagtggcaggccccgcacaaggagagtctgagctcagacatgcctaaccctgaccagacctgatggtctttctctacctgccctggtaacagaagacaaaggacataatctcttgggaactctatggccctgcctaccacctgaccttagggcaagcttgtatcctccctatactactgcagctgatgtgctcttaaaagcaccacctcctggctggaggccaaccaaaacaaaactagcaccttttgttgttgtcattgttgttgagacagagtttccctcttgttgcccagactggagtgcaatggcatgatctcagctcactgcaacctctgcctctcaggttcaagctattctcctgcctcagcctcccaaagtagctgggattacaggtgcccaccaacgtgcccagctaatttttttgtatttttagttgagacggggtttcaccatgttggccaggctggtcttgaacgcctgacctcaggtgatccacccgcctcggcctcctgaagtcctgggattacaggtgtgagccaccacacccaaccaaaactagcacacttaataaaaatacaaccaaggaccctcacagagtccaggcgctggtatccacagctgagagacctaaagacggatcacatcacaggactctttgcagacactcctcagtaccagcccagaggctggtagctcttctgggtggctagatctagaagagaaataccaatcactgcaatttggctctcaggaagtcctattccaagggtgtgggggagagcaccacatcaagggagaaccctgtgggacaaaggaatctaaacagcagcccttgagtcccagatcttccctctgacatagcccacacaaatgagaaggaactagaaaaacaattctggtaatacaacaaaacaatgttctttaacaccctcaaaaaatcacgctaacttaccagcaatggatccaaaccaaaatgaaatccctgaactgccagaaaaagaattcagaaggtcaattgttaagctaatcaaggaggcaccagagaaaggtgaagtcctacttaaagaaattttaaaaaatgatataggatatgtgataaacatcataaaaaatgatataggatatatcatataagatataggatatatgacaggttttccttcatacgttacctgatacttttgcctcataactcttaagattctttccttcatcttgactagataatgtgatgaatatgtgccaaggtaatgatctttttgtgatgaatttccaaggttttctttgagcttcttgtatttggatgtctaggtctctagaaaggccagggaagttttccttgattattccctcaaatatgttttttaaacttttagatttcttttcttcctcaggaatatcaattattcttatattttgtcacttaacaaagcaagcactagtagctattcttacatcagacaaaacaaactttaaagcagcggcagttaaaaaagacaaagagagacattatataatgatgaacagactagcccaacaggaaaatatcacaatactaaatatatattcacctaacacaggagctcccagatttataaaacaattactactagacctaagaaatgagatagacagcaacacaataatagtgggggacttcaatactccacagacagcactagtcaggtcatcaagacataaggtcaacaaagaaacaatagacttaaactataccctagaacaaatggacttaacagatatttacagaagattctacccaacaactgcagaatatagattcaatgcatcagcacagggaacgtactccaagacagaccatatgataggccacaaaacaagtctcaacaaatttaagaaaatagagattatatcaaatactctctcagaccacagtggaataaaattggaaatcaactctaaaaggaaccctcaaaaccatgcaaatacacagaaattaacctgctcctgaatgatctttgggtcaacaatgaaatcaagatgaaaattaacaaattcattgaactcaacaataatagtgaaacaacctatcaaaacttctgggatacagcaaacgcagtgctaagaggaaaggtcagaagttcagagtgttaaatgcctacatcaaaaattccgaaaaggcacaaatagacaatctaaggtcacacctcgaggaactagagaaataagaacaaaccaaaccccaacccagcagaagaaaagaaataaccaagataagagcagtactaaatgaaattgaaacaacaacaacagaaaaaatacagaagataaatggaacaaaaagctggttcaaaagataaataaaattgatagaccattagtgagattaaccaacaaaagaagagagaagatctaaataagctcaatcagaaacgaaacaggagatattaccactgataccacagaaatataaaagatccttcaagggtactatgaacacctttacacgcataaactagaaaacctagatgagatgaatacattcctggaaatacacaaccctccttgattaaaccaggaagaaacagaaactctgaacagaccaataacaaggagtgagattgaaatggtatctaaaaagttaccaacaaaaaaaaaaggtctacgaccagacgaattcacaactgaatatatatcagacattccaagaagaattggtaccaatcctattgacactattccaaaagacagagaaagagggaatccttcctaaatcattccatgaatccagtatcaccctaataccaaaaccaggaaaggaaataacaaaaaaaagaaaactacagatcaatatccctgatgaacatagatgcgaaaatcctcaacaaaatactagctaacagaatccaacagcatatcaaaaagataatccaccatgatcaagtgggtttcatactagggatgtagggatggtttaatatatgcaagtcaataaatgtgatacaccacataaacagaattaaaaacaaaaaccacatgatcatctcaatacacacagaaaaaacatttgacaaaatccagcatctgattaaatgctcaaatgattaaaaccctcagcaaaattcgcatacaaaggacatacctcactgtaataaaataaaatattatcactgtaataaaagccatctatgacaaatccacagcaaacataatactgaatgggaaaaagttgataggattccctctgagaactggaacaaaacaaggatgcccactcttaccaatctattcaacatagtattggaagttctgcccagaatattcagacaagagagaagaataaagggcatccaaatcagtaaagaggatgtcaaactgtcactgtatgctgatgacatgatcatatacctagaaaaccataagggctcatccaaaacgctcctagaactggcaaatgaattcagcaaaattccaggatacaaaattaatgtacagaaatgaatagctctgctatacgccaacagcgaccaagctgaaaatcaaatcaagaactcaatcccttttacaataggtgcaaaaaataaaaataaaatacctagggctatacctaaccaaggagatgaaagacctctacgaggaaaactacaaaacactgctgaaagaaatcatagatgacacacaaatggaaacacatcccctactcatgaatgagtagaatcaatattgtgaaaatgaccatactgtcaaaagcaatctatagattcaatgcaattcccctcagaatatcatcatcattcttcacagaactaggaaaaaatcctaaaattcgaatgaaaccaaaaaagaccatagagagccaaagcaagactaaacaacaacaacaacaaaatctggaggaatcacattacccaacttcaaactatactgcaaaactatagttaccaaaacaatatggtactagtataaaaataggcacataaaccaatggaacagaatagagaacccagaaatacagccaaataattacagtcaactgatctttgacaaagcaaacaaaaacataaagtggggaaaggacaccctattcaacaaatgctgctgggataattggcaagccatatgaagctgaatgaaactggatcctcatctctcaccttacacaaaaatcaactcaagatggatcaaagacttaaatctaagaccagaaaccataaaaattctagaagataacattggaaaaacccttgtagacattggcttagatatagacttcatgaccaagaacccaaaagcaaatggaacaaaaccaaagataaatagatgaaactgaattaaactaaaaagcttctgcacagcagaagaaatagccagcaaaataaacagacaacacacagagtgggagaaaatattcacaatctatacttctgacaaaagactgataaccagaatctgcaaggaactcaaacaaatcagcaggaaaaaacaaacaaacaaacaaacaccccagaattgggcaaaggacatgaatagacaattctcaaaagaagatatacaaatggccaaaaaacatatgaaaaatgctcaatatcactattatcagggaagtgtgaataaaaaccacaatgcaataccgccttactcctgcaataatggccataatcaaaaaatagatgttggcgtgaatgtggtgaaaagggaacacttttacactgttggtgggaatgtaaactagtacaaccactatggaaaacagtgtggagattccttaaagaactgaaagtagatctaccgtttgatccagcaatcccattcctgggtatccatccagaggaaaataagtcattatatgaaaaagatacttgcacacgcatgtttttttttgttttttttttttttgtcttttaacagccaacagtttattgtacactagtcttgagcagcttcaatctgaattcatctccccaggacaggaagaagtcaggagatctcggggagacagagcttatatcctttcttattcagaactgccacaacccctatccctcaccagtcaggccccacatcacaccagtggcccagctggaattctaacatcagctaattcctttatattcttgtcgttcttgacattgccagaaaacgtaatctctcatgctttccaatcccaatagtgttttctctgggcctcctaacccccctctctgtccacaaatctccttttcagttgcaacccccatccaattttaaacaacttccacattttcaatactgaggttaatcattaattgagctgtaatgggtatgtgttgtctactaagtgttttggaaagtcactttgacacttatctaatattataggcatgcactcatccttcccatgacccttttccttccacatactttagaatgttcttccttgataggaatgtaagctctatgagggcatgtgtttttgttttattcactaatgtggatcaagtaaccatagcagcgcctctcgtatagtaggtattcaataaataagcattgaataaatgaatttaatgagcatacattcagcaaatatatggttatatgacaatatgacaatgaatgagtaaaataatattttcccttatggagtttacattctaatgtgtaaatgccggaagcctatgacaaacagacaataagcatgtaaacagatataattccatactctcattaatctatggggaaaataaatcacattagggaaatagagaatgactggtagaaagaattttggttattttagatagactggttaagacaattctccttggggaggcaaatctgggcagaatactgatgtgaggcaaaatgaagattttggacataaaaagacttgggaataggcaggagtaataaacagagaatataaagatcttgatatggcaaaatgttttatgcatttgagagaaagagtggttggagataatgttagggagatgaggaaaggccatgttgtacaggtcttacaggttacctatacctgggggtccctaacccctgggccttggacggataccagtaccggtctgtggcatattaaaaactgggtggcacagcaggaggtgagcagcgggctagcgagcattacctcctgagctccgcctcctgtcagatcagtggtggcattagattctcataggacaggaaccctattgtgaactgctcatgcaagggatctaggttgcactctccttatgataatctaatgcctgatgatctgaggtggaacagtttaatccccaaactatccccacactgtcccttcccacagaaaaattgtcttccttgaaaccagtccctggggccaaaaatattagggaccactgatctataggattttcattttatttaaatgtgatgtgaaagcatgggaaagtttggaaaagtctcatgatcttatttaggatgataaaatcatgaattaaaaagctacttggtggagagagaaagcaaagagaccagcaaggaggctattgtagcatcaagtgacaaatgatggtggattgagccagaatggtggcagtggagtggaatcaggttctggatattctttgaagatggatttgatatggtaagggaaggagaggaattaagaataggtcctagattcctcagctgagctgggaaaatccattttactattagtgtttcctcaggaagagaatgagctaatacatttggggaaaatattatcacttcctgaaaactgaaaagaaaatgatcattttttaaaaatctattgtatcctttgttttctcttaacgttcttttgtctcccagccttttattttgaaaaatgttaacttcaataagaatttgaaaaaaatagtacaaccatataccctttacctacgttcactaattattaacattttgctacatttgctttctctgtcttttcacatatacacacaaacacacacagtttttctctgaaatatttgaaagtatgttgcagacatcatgaaactgcactgctagtattttggtatatatttacacatatttactgagaacaagaagattttcttatagaaatacaagaccagagaaattttacatagctacagtgctttttttttaaaatttatctcccactatctctttatttatttatttatttatttattattatactttaagttttagggtatatgtgcacaatgtgcaggttagttacatatgtatacatgtgccatgctggtgcgctgcacccactaactcgtcatctagcattaggtatatctcccaatgctatccctcccccctccccccaccccacaacagtccccagagcgtgatgttccccttccagtgtccatgtgttctcattgttcaattcccacctatgagagagaatatgcgatgtttggttttttgttcttgtgatagtttactgagaatgatgatttccaatttcatccatgtccttacaaaggacatgaactcatcattttttatggctgcatagtattccatggtgtatatgtgccacattttcttaatccagtctatcattgttgggcatttgggttggttccaagtctttgctattgtgaataatgccgcaataaacatacgacacatgcatgtttatagcagtataatttgcaattacaaaacatggaaccagctcaaatgtccatcaatcaatgagtggataaagaaaatgtggtatatatgtatatataccatggaatacgactcagccataaaaaggaacaaaataatggcattcgcaacaacctggatggagttggagaccattatcataagtgaagtaactcaggaatggaaaaccaaacatcatatattctcactcataagtgggagctaagctatgaggatgcaaaggcataagaatgatacaatggactttggagatcaaggaaaagggtggtgggggtgggggataaaactctacacactgggtacagtgtacactgcccgggtgatgggtgcaccaaaattttagaaatcaccactaaagaacttattcatgtacaataaataaataaataaaaattaacagggggaaaattggtacatggaatgtcagggggccttaggcaacgctgccctggggcagaaccccctgctctcccaccaagacacagtgccctccccaaccctatcaagcagctggccctgaaggaacagtgtacacctgaggggcccaggcaggaggctggagcttagggcataggagaggagccaagaggttgtgaagacagagtagctgcaggggaggtgcagactccaccacctaaagggtgcctgcaggggcctgagagccaagaccaaggctctgcaccatggggtggcctcctgcatctcccgccatgtggactctgcacaggttggattatatcccttgaacctgaagagccgccttaacattttttgggattccatgtttgtgctgacaacaccaccccttccttccacaacactgggcatggtgcccaacttggaccatgggttgtcaatcaacgagtggatgatcagccctcaggccaagtcctcccacaccctgtgtttgtgaatacaatgttattgatcaaggcagtgcacattgatgaaactgttgtccacacctgccttcacgctgtaacagcagggatgagttgttgtgacagagaccatgtggtagcaaagcctgaaatatttaccctctagctctttacagaaaggattgtcaatcctgaggaaatcaacaggaaggaaactattccagtttctaaaaatgtgagtgttttgtgtggtgaaagagaccatacatttctaagagaaatgatagagacagactggagaaaatacttgcaacatatgcatttacaaaatttaataactcttggctgggcgtggtggctcatgcctataatcccagcactttgggaggccgaggcagctgaatcacttgaaccccggaggtggaggttgcggaaagccgagattgtgccactacactccagcctgggcaacagagcaagactccatctcaaaaaaaaaaaattaataactctaatattccaaggcttctacaaattaatgagaaaaaggcaaacacaataaaatagaaaaatagaaaaatgggcaaaggagttgaacagaaaaagcacaccaaatacaaatgatttatgaatttatgagagacaaatgtcataagttattaagaaaacagaaatgtcacagtgtttttcactcacattgatagtattgagtcttgataaggatgaagggaacgctgtgcctttgggagaagcatcaatgagcacacttgttttggagagggtaatctatctaaactaacactaaattttttaaaaatgcatatctttgctagatagtatcatttctagatgtctaatctatagaaataatcatacaagttcaaaaataaatacagaaggattgtcatcctatcattacatgagataacatttttttagagaaaacctgaacactaattaatggaaaatggttacataaattgtaatgcatacattttgtaaaataggcagttattaaaaggaatgaaatgcatcaatattttctaaatgtaataactactaagatatattgttgagtaaaaaagcaagttgaaaaacattatgaattgcatgattgcattctaaaacataaaatctgtgtgtgtgtatgtgtgtgcacatgtgtgtgtatgtgtgcatgtgtatgtgttctagggaaaggagcgatggccacctacctccttcactggtgtgtggtaggcagggttgctgctctataagctaagatattgatttggctgctttagcaaagatcaaaataacagtgacttaacaataaagaagtttggttctccctctcgttaaagtcttggattagtagaaaggccagaggtcaaagtttccagagtcctacctgtctcatcactgtgccattctgtcagtgcatctcagctccacacagttgcagctggaggaccatggcctgggcagcaggaagggggaatgtggaggaaaggacagataggctctgtggaaggcatgacccagagttctacatgtgatttaaatcaccttcttttggccaaaacatagtcatgtggccacaccacgtaggctgggaaaaaaagcagtccttggctaggcagccccatgcccagctaaaatgtagaggtatctgttattaaaagaaaaacagaagaagtcaatatttgggtataatgagtagtctcttcctatggatgtcctgctgtcttccttgccaacagaaaatcataaaatcgacaatggagaaacagcagacggattatgaaagaatgcaatttgtctatagcagacttatccacaacagtaacaggcaacagaagatggaaaattatatttgcaaagtaatgagagaaaccagtgtgagcatagcatcctacattatgcaaatgatcatttaagaggaagggaaagagaaaaacatttcagagcaagacagtgagaattggccaggcacggtggctcgtgcctttaatcccagcattttgggaggccaaagcaggaggattgcttgagcccaggagtttgagaccagcctgggcaacttggtgaaatcctgtctgtattaaaaacaaaacaaaacaaaacagaaaaaaaaaaaggtagtgagaatgtaccattaatagacatgtgctgaaagaactactaacagatgtactatatttcaagaagaaggaaattgaacacagaaggaactgaggtgcaagaagtaatggtatagaagaacactggaaatatatggtatttctagaaagctttagctgaatccatcagtaataataaacgtaatagttctgaatgtataaaagtaagttggaaatttccagctggaaaaagatggcttagactagttttccttgcaccttccctctacacacagctataaaccctagaataatgtaagaggcaaccaaaggagaactctcataggtgttaacaggaaagtgaactggtttgggcctcagggatggatgaagtgcagctgcagggaatcttatttccccttaccagatggaggacagtgacccaggtccagtgtttcccatccccaacacagtgacagaaggcagccaaggaatcctcattcctgtcctggaactacaggagtccctcctacagcaccaggtgtattcatcttctgttgttgctataacaaaattaccacaaacttagtggcttaagtaactacacatttattattttccagttgtggaggtcagaggtctcaaactggtctcactgggaaaaactcaaggtcttcagggctgtattccctttggagctctagggggggatccattcccttgtcatttccagctttagaggctgcccacactccttggctagtggccccttcctccatctccaagccagccacatcatgttgagtcctgctcattcttccatctcttattttctctctactgccttcaccttccattaacaagaactcttgtgattacattgtatgtttgtggttacactacagaatccaagatgacctccccatctcaaggtcaactaattaacaccttaattctatttgcaatctttgtcattaccataacatattcatgggttctgggataaggggtagacatttttatggaggcattagtctgcttaccacagactgccctctggcccccaaagatacacatctatcccatatgcaaaatgcattccactccaagattcccagccttatcaacccattaaagtaacaactcaaagtccaaaatctcatctaactttcagattagctccaaagtgccaaaatgcatcatccgaggctctgggagtgatccatcctggggcacaattcttcttcatctgtgaacctgggaaattcaagaaacaagttatctactcccaaaatacaaaggtgagacaggcatgggataacagtgatagatatttccattcaaaaagagaagaggaagaaaaaggagttgccagtcccaatcaatttcaaaatcaagccaggcacattccattttgtttcaaggcctgagaataattctctgtggctcaagactcagacccccctgagctagtggctctgcctttggagtcatccttcctttttcttgaagggtatcacatgtttacagctgagtagttttatcatcacattttttgcctgtagaatttgagagtggcgggggcggtctaacagccctttttcattttgctttctctctgtacttttctttccaagctagcagtgtttctgttggtataacatcctcaagagccttgtgagtctcccatgtttgtcacagggattcacaccattggataagagactcatctaaggatctttcatagagttcagtgccacctgcaagggagatataccaggatcccaccatcaataagtgggcaagagaagtcctcacctcctctgcagcctgaaactcccctctcccatcaagaaacagcaggccaggtggagaaggcactggcagagggcatcctgtcataagtacctcctctgggaagactctctgtgccctataagcagaagagatcctgtcacaagggcccagcttggaaagcctctgtttttgtgtgggcctgggtcttcccaccccactgagtgacaccaggccaacaaacctagggaaataccttcagccctctgggcagcaacagcagggaccagtgaagagcctagcagcaccagctaaaccaaacaggtgaaaatgacaccacaaagtttctgaaaattaaactgttattggaaccatggcccacaaaagtaggtcattactcacatactaagccttaacagggtgattgccttgctacaatagaaaatttaaatagaaatcagtctcctaacagaagaaacaaaatgtccagaatacaataacataccaagaaacaggaaagcaacaacttgaatgagaaaagacaatcgaataatatcaacatggagacgaattaggtattgaaatattctggctaggactttacaggaaccatcataaaaatgcttcaaaaattaattacaggggccgggcaggtggctcacacctgtaatcccagaactttgggaggccgaggcaggcggatcacctgaggtcaggagttcgagaccagcctggccaatgtggtgaaaccccatctctactgaaaatgcaaaaattagcctggcatggtggcaggtgcctgtaatctcagctactcaggagggtgaggcgggagaacctcttgaacccaggaggcagaggttgcagtgagcagagatcatgccactgcactccagcctgggtgacaagagggaaacttcatctcaaaaaaaaaaaattaattacaaatgaaaaaatagaaaatatcagcaaaaagtagaagttacaaatttgttgggttaaattacattaatagattttatgatgtagaaccatcatttattttattgtaaaaatacaataaaataaattaaaaacttgctggatgagctcaatggtagaatggaagtgacaaagcataaaatctgtgaatatgagaacagatcaatagcacttgctcatcatgtgaataacatcattaagaataacagaaaaaaaatcatctgaaaaaaatgaacagagcctcagggaccttgttagagtaaaaaaaaaaatctgacttccatactatcagagcctaataagaagagaagaaagagttgaaagaatatttgaagaaataattcccattttgatgaaagatataaatctacagattcaagaaactatgataatcacaaacaagataaacccaaagaaatccataccaagacacatcatcattaacttaataaaactaaagacaaaaaaaattgaaaacagccagaagaaatgacatcttaacctacaagtgtcatttgaataagagtggatttcttatttgaaaccatggatgataaatatcttataaaacataaagtagaacatattttacatagactatagtctcttataaaaataaaatataaaagaaaaatctctttgcactcccatgttcaagggtggaagaagagggatgtcccaggggagggaaggaggaagagaatttgcccttctcccacctttttgttctatcaggtcctcaacagatgggaagatgcccatccacattggtgagggtagatctttactcagtccaccacttcaaatgccaatctcttctagaagaactctcacagacacactcagaaataatgtgttaccagccatcagggcatgttttaggccagtcaagttgacacataaaattagccatcactgtgtacttttcctgccctggtctttgatttggcctagtggtgatagggaatttagaaccccagatccagtctctagctgtgctcattgctcctggagcaccatgcttctggctctttcagaacagaagtagaaaatatatgagtttttcatttgtttgctttttaaatctatcctgttccctcaaattctaaccaacaccacagtactcttccggtcttagagcttcaaacttatgtttgttttatctgaattccttcctcaggaaaggaccctcaggcctgtcaacgaaagtatcaaagaactgaaactcacaaaatcaccacatcctgataatgagatgccagacccctcattcatcatgattgcttccttaacctctctaattcctgttttcttatacattattacatttcttcccaggtatataaacctttaattttggtgggtcaggcagaaggatttgagactgaactctcatttccttggctacctcagtgattggctgtgcagcaagcagcaggacctcagtggacccctggtgttttggtaacataatcacatcatatttctccttcaatttattgggttaagttacattaatagattttatgatgtagaaccatccttacattcttgcaataaactgtattagttgtgaattggtggattcgactaatatttcattcaggtttataaataaaatgtctgtaattatcacttctgatgttgttcttaactggttttggaatcaaaacaatgttcactttttagaatgaacttgaagacgttatctcttttggtatattttggaacaacttgcttaacttgaacatttgtatataatttgaaaattttgtaaaatttaccttcaaaaccattttggcctggggttgtttgtttgaggggttgacggaaggcagagcttggactattacaactgtattaatgtttcctggtttacctgttccaatttttttcttcttatgcagttttggttttctatatttttataagattttattcattgaattgagggcttcaatttttcatttacaataaaattctcctttacaatttttaaaaatctccactgtgtttgcagttattatctctttttgttctgtatttcctctcatagtttacttttatgatcatcttttttccttggtgagtcttgtgagatgtgtctgtcttgttaattttttcaatgactttatttctgccttcgttaatcttctccattgttttgattgatgtgtgccctgatggttattatctccttttgtgtggttttttttttttttttggttttactttgttgctcttattccaactcttgagttgaatgctagtttgtttttaaaaattgtattttctgaaaaatggtcttaaagctataattctccttctaacaattgctttattggcagtctgtgtttttattatcatttagttttaaatattccgcaacttccttttaaatccaagagtgattttgtaaaatgctatttatttccaaaaaaaaaaattggattaaaaatctcttttgggccaggcacagtggcagcactttgggaggccaaggcaggtggatcatgaggtcaagagattgagcccatcctggccaacatggcgaaagcccatctctactaaaaatataaaaattagctgggcatggtggcacatgcttgtagtcccagctactcgggaggctgaggcaggagaattgcttgaacccgggaggcggaggttgcagtgagctgagattgcaccactgcactccagcctggtgacagagtgagactccatctcaaaaacaaaacaaaacaaaaaaactcttttgttgttttagttgtattatatttaggaaacatgctttgtgtgaaattcatcctttggaatttaagagagctttccctatgttctaatgcatggtcaatttttgtacatgttccttgattgccctaatttaatgtgtattacctattttggggggtttagagttctttatatatctattaattatagtgatcagaccttgatacgcatgctaattttttggtctgttttatccataagtttctaaagcagtatgttaaaatatcctactataattattgattcttctatttatatctataattttttcagttgttaccttacatattttgttgctataattgtggggacacaatttcatgatgttgatgtgtatattttgtatttcttttaagtagtttaaatatcattattctggaaattttatcctaaattttattagaaacatacttcattgtttctaagtcaagatttttacaaattctggcatctctaaaactgagttgctgagttgctaattaatgaggataaagttctagttaaacaaaatgaataagttctagagatctgctatacaacattgtaacctatctttaactataccctattgagccataatccagccactgtactccagcctggcccacagagcaagaccctgtctctaaaaaccaacaataactacaacaacaacattgtattgtacactttaaaatgtgttaagatggtatatttcatgttaagtgttcttatcataataaaataaaatttcaaagtaaaattgagttgtttcttttacctgctgtctgggaggcagtagatgtgacctaggtgttattgcctgtgtttatgtgaacataatgataactgttctttttgtcattacttcaattgagttctgtgcatttttggcactagatgtgctgaatttaattgctgtttataatttatttaaaagcttacatgatgatttggcattgaagtgaaaagttatatcgtaagcagaaaattaactataagaggctagtgtgacctatttatatgtcatgcaggactatagtcaaggtatcaaatatcgatttgtcagaaacttgctgctgactttgatctgaagctatttaacttctaagaacatatgattccactgaggaaaaaaatgaagctatgaatgaaataaaaaatgaaatactaataaaactgagtttttacagaacaattgctaaaggtgcttattatgaacacaggttagaaaaatattacatcactctgatgctatgcataatcaccaaaggtcaaatgttgttaccatatttaattttaaaccacaaacaataacaaaatgtaagttatttcccaaaatatcttattgtgcttgcactaaaaagaagaaaaaggcattagataaactgatgacagaataattaaaagaggctgggcgcggtggctcaagcctataatcccagcactttgggaggccgaggcaggtagatcacctgaggtcaggagttacagaccagcctggccaacatggtgaaaccctgagtctacgaaaaatacaaacaatagctgggcatggtggtgggtgcctataatcccagctactcaggaggctgaggcaggagaatcacttgaacctaagaagcagaggttgcagtgagccaagatcgcaccattgctttctgggcaagagagtgagactctgtctcaaaaaaaaaaagaaaaaaaactcaaagaatctggaatggatgtctaggagactaagtaactaagcatatttgttttgatgtatctgatcagctaaagaataagttcactaagaagtgaattaggttggtggttgttccataatgtatgactccttgaagattccatcagcaaaccatttaacacttatttgaagaaggaacacgatttctgtttgttgtctgaaaaccttgcactgattgcaagttctggtaagatcactaaagcactggcatcaacttaaaaatggcatccatgtcttgaaagaaaaaaaaatctcagacaacattgaagcactcttaaacagtgcttcatcacaaattctatcattatcacagagggcatttgagtatgctcaaaagcttgggtaactgactgtgagtgaaaaagtaattcaaaagaattatattctgatttggaaaagtttgttttccttttatatattagggctatctatttccagaatttttaatttaattttactttaatttttttagacaaagtctcactctgtcacccaggctagagtgcagtggcacaatctcggctcactgcaacctctgtctcccaggttcaaatgattctcttgcctcagcctcctgtgtagctgggactacaggtacccaccatcatgtccggctaatttttgtatttttaatagagacagggtttcaccatgtttgctagtctggtctcaagtgatccacctgccttcacctcccaaagtgctgggattacaggctagagttttatttttaattctaccgtctctttaagtttcttctggagaccacatactgttggatatgtttttgtttcaaattctgagagtctcagccttttaattgttggatttaacccatttatattttgtaatttctgttatattagtgattatttcttccaacttcatatttacatttactttttcccattatattcttttattgatttaaaagttataactataatttatgttctatgacagttgccttaatttaatatccaaatatatgtttatttgcttcttttattttcttaagcaaatattaatatatacatttttcccttaacaataaaagtatttttgatgcttattatacccttggcctctctttcttgctctctcaatccctgtcatattgatattatttaaaattttagttcttggttgccatatatgtttttttcttttctttggtcttagagtgagggcgtttgtacttttcttccctcctaaggcaagggtaacacttgctgattcatctgaggatgcttattgcccatacctcccgtattatccttctgaatctgtagctcctcttttttatgtactttccttgaaaatattttaaatgtgagtctttgttgatctttgtgtggcaagcctgatactctaaatgcctgagcacattttaaatatatacttaggttttaatgaaaaattggagataaaaatttcagtttcaaaatttttattttcaatactttaaaatatttctcagttgttctattgcttccaatgttgtgtttgagaagtttgatgccaatttgattcttattcctttgtaagtgctctctgcaagcatttagaattttccctgtctcctaaatgttttaaattcactgtaatgtatctgggtgtgtctttttctttatgttttctgtttgagccctatttgtctttatttctgggacattcatctttgcttttattcaaatatttctttttctccctctttctctttttcttttgagactccatttacccctaccctttggatattggcacttctatatctatcttccatatcttttatcttatttcacagttttaatctctttattctttcctgccctctgaagtgttctcagccttcactctcaattccctaacctgcttctcagctctggctcactctagaaggcccatgtcaatagacctgtccgtggttttctaacttttaccatcacacatagcactgcagtgaataacctgcacatgtgaaaggatctctataggataaatgcccaaaatttgaattgtgagtcaaaggacatctgaatttctaatttctgataggtaaatttttctccacagtggtggaccgaattacactccacccagcaatgtgtaagagtgtggtttcttttacattttcctaatgatgaattgtgttgaacattgtttcacgtgtttattgaccatctgcatatcttctttggtgatatctattcgagtcctttgcccattaaaaacattgagttgtcattttgttattgggttgttaattcatattttctacttaattgttgcttttatacgtgaaaagctgtgggtctcaatattaattttgttcattgctactgtagtaaattttcttattatttgttgtactttttcactgtgttggatttttcaggcatgcaatcatgttatctgcaaataggctagctcctctttactgctgtttctcttgtctataatactcgtgttggctggtacctctaatgcaatgttaaataacaatggttacaggagacattctcgttttgtttctgacactctcaggaatccttctaatgatgtgaatttgcggactggaatagatttatattgataatgctatgaagtattagtctatattggcttatttaagatattaaaatcagactagatttaagttttctatggtctatggaactgatcatatgacttatctctttagagccaatgattttgtgaattatattaatttcctgacattcagtcatcctattattcctggaataaattctgcatagtcataaggaacacattcttattctaaggcattgttatattctgtttcctaatattttatttaagatttttaaattggaattaataagcaaaattggtgtgtatcttccttttctgtgtctatactccctgccaaatttcaatgttacttttatgtcacagaaaacatttagaagtttttctcatttttcaatgttttgtagcagtttaaaaaacacagaaaatgtctgttatttattaaagacaatgtaaattcccttataacattatcaaaggctattctggagactagcttattgacaactatattagtctgctggggttgtcataacaaagtatcacaaactaagtggcttaaacaacagaaatttattgtcttacagttctggaggccggaagttgagatcaaggtgtcagcagggctgtgctctgcggagaatgctggggaaggatctgtccaggactctctccgcttctggtggttccttggcatgtggcagcatcactccaatcagcatgtggcatcctccctgtgtgcctgggtctgtgtccagacttccccttttcagaaggacaccagctgtgttgaatgacagcccacctggctccagtgtgacctcattctaacttaactaacatctgcaatgaccctgtttccaaatgaggtcacaatctgagggactggggcttaggacttcaacgcaggaattcgggggcatacaattcaacccagaacaacaaccttatccatgtcttcactctatttaaacttcctaactcttttggagctcgttgtgataagttatatttttctaagaaactatccatttgttaaatgttttcaaatatagctgaataaaatggatcaagttaatctttatgattttattttctgttgctttttcctctgcaaaaataaataattaatttttaatttttgtttctggttatttctcccttattgttttttctttgtggtgtttaaaaagctattttgcttatattatttagcagtttacacattccaccccaccccatcccccaaccatgaacttttgtatttatttctcaattgtactgttttttccccaaatcactgatttatatttttctttgttaatgcttcctttatgctttctttcagtttatttttctttaaatgactaaatgtacttattttaaaataattatacagtaaaattgacattttttactctttgaaggtaaagtccatgaattataacatatatacattcatgtgactactgccatcaccacggtacacagttgttctatgacctaaaaagaaaacccccaaacaagaaaacttcgtgtgctgttgacacgcttgcccggtcccggccccatcccccactgatctcctttgctgtcattctgttctcccccactgtagttttgtcttttgggcaatctcatgctaatagaatcatcccgtatataaactttggagaccactactctcacaagcacagtgcctttgagattcattcagattgttctgggtgtccatacaggccagtctctgtggggctgctgcacaccacaccccctccccaccagcccacctctgagtgggccaagggcccagggtctatttcctgatagaaatctcaagcaacaagagtaattcctgacaagtgcccatttccttccctcatgacaagatgcacaatttatcttccgggaaggaacgcccagcctttggcataactttcttaagactcccaatctgctaattcatttcaagagaaaggaaaaaccctttgtttccaggtgagtgctgggagtgtggtatgatggggattcttcagacccaggaagtgacctggccaagggtcccctggtcttctccatccttccttccccaggttgccccctgctctctgacccccttcgcctgattccagctgtgtttttagtgctccctgatgttcctgcaccctgagaccctcaaccaccccacagtacaacagctcctgacacaccccgcagggcttttccatttttaggtggctcaaccctgctgcagcttttaactctgctagccagcaatttttttttcttttctttttttttttttttgagatggagtcttgctctcttgcctggagtgcagtggcacgatctcggctcattgcaagctctgcctcctgggttcacaccattctcctgcctcagcctcccgaatagctgggactacaggcgcccaccacctcgcccggctaattttttgtatttttagtagagacggggtttcaccatgttagccaggatggtatcgatctcctgacctcatgatacacctgcgtcggcctcccaaagtgctgggattacaggcgtgagccatcgcgcctggcttttttttgtttgtttgtttgttttaccacaaatgtcatacaggctggttgcaagaaaatgcaagtaacacataaatatattaagtaaaatataaattgtgctttcactgcctgcctccaacaccaaggtccatttcagaggtgaccactctttatggacagcttgagatatgtgcttccagattgttttgtgtgcatctgcaaagacacacacacacacacatccctcacacacgtgttcacacatacccctgtacttctgtagtagactcttggtgctgtgtagattttcttcatctggctggtgcatccttcccagctgcaccctactctggagactcaaccagggcagaagcaatctgtctcatccagaaatgtctggaagtggtacccagcccgtagagcagcccctagtcagccactgagtaatacaggcacaaaatccccgcccccttgcttggaggtggggccgctctgtggtagctttcgcattccagagctcccctgggaccaggctgaggcttccactggatcccttgcccggcttctcccctgcccttctaagcttcccctgagagcactttctcagcaaatctcttgcacataggcctgtgtaataggtatgcataggcacacgtagctgttctcagagaggagctcctgctcactgaagcagagggtggtgtctttcttcacatgacagcaccccatggccacctctgaatgtgagtctacttcactttcttatggcagcagagctccccctggaattgattaatagccctattagtgagattgagctcattcattcattagacacatggtttatgaagtgctactgtatgccaagtactgctttaagcactggggctgtctccaacttttctctcttacagaagatcggaatatttttaaagcatattcaagcatttgtgtaaatggttctgaagcacagattcctggagatggaattgtgggtcagagggaaactgcatttgcagccaggatgggtgtctcttggggaagtgttcctccttcagctccagcgacagctccttgctttgtgtctacttttctcccccatctctgccttggcaacctctcctccccagcccttcccacctacccagggaacacctgaaaccctggcagagctgctgctgagccctcccccatgctgctgatctgggcatttgcccttcctgctgcctcaggccctcagaaaccaaggcctcccagcctgtcttctctctggtccctggtttacggaagaggatgttgggattcagagaggttaagtgacctacttttctagaccaatttgttcaagttcctcccaaacatctccaccagcctgtcccagaggcacttcaaattcagcatcctggattattctcttcatgtctgccctaaaacttgccttttctgttccctataataaatgcccaagagaaaatgtcccatgacagctgactctcccacccctccttgtcaggcacaggtctcctgagctctcctgagcctgtctcctgggtctgccattgtgactgtcccctgcagccctgatctggatttgtggccaccagctcccttactgcttccaccagctggacatccttggtcctcacaggccctggagagttcatcttccagggctgctgtcagcatccccccttggctcaagcagcccgccggggactcaggagggccggtggcaccagaggccagcgcagtccgactcaggtcattccatgcaggcgcctttcaggtcctcaggacctggggaccagcaccacacacagctgtgggtcctctcgagccaataccatgtctcagcccctgtagcctgccccgtgctgccctcctcttacctcgcaggacctcctttcttggccccctggatagctgcctcttcctttccaggacagcctgggactctgggatttgccaatatatgtgtggggcatcagaggagctgagtgctgcctgtgaagggcattgacgacgtgtcggggaaatgggaaaggatgggagggtagacatccgggttggtgtcctagagatccaagacgcgcagctcaccatgctgcttgccttcaggtgcctcattggtaagtcaaaggcaacagatagaggctcccagaaggcccttcccagagagcaactctttagagatctaagcatcttcggagaaaatttgggagcttggatggtttgtatcaggcctctgttttttcttggactcttttgggtatcttcatgcccctcgagtgcttatcaggatgccacacggcacagcaggtggtgaatatatgtgtcataagtgagcgagaagcaaggcttttcatcagggaaagtatgacttctctgatggagcaatgtcactccattttacttacctgcaggaatgtttaacacgagagtgaccaggacactgcaagtggctgtgttagttggtaaaccttttcagaggacagtttagtaatccatatggaaagttctaaaattatgcaatgcctttaattttacttactgaaattctaaagaaataattaaggatgtgtgtaagatttagtggaaggttgatctttgcaagggctatttataataaagttgaaaacaacctgtgtccaataacaggagattggttaactaagttctggaacttagatacaatggaattctgagtagccactaaaaattatgttattgaagtatatttcgggtgtgggaaaaaagtcgtaataagttactgaattgagtcatgttataaaatagtatgtacttaatggaaacattttagaacaaaaatgtatatgctacacatttttaaacatctgtgagggtcttgctactcaaagtgtggtccccggaccagctgtttctgcatcattgggagcttgtcagaatcacagaactgcagcccagcacaacctcaggtgattcccatgcagagaggtcccaacgctgggttgcggcacccacacaaacatcacatctgtgtgtggggctactaggagtctattatttcccctttttgcttatttatttgtggcaactgtatgttactgacataataaagaaaaaagaaagatggacacactctgaaaaacacacagtgggcttcattgtcatggaagctttcctggctctttcctgtctgggacgccctcactgagttcactttaagtcccgctccttcttgggtgcatttgactctggtatggggggctcttggcttgaagagtggcactttcagaatcactgctgctttcaaaggggctctgctcctgccagacagggtggagactgaaggcccaagggccttcggtcccccagaccccacccagggcatgggccaggccccttgcttgccctcccactctgccgcatggtctgcccattaggatgcaggccgcttggcagattaggtcatttcttttccagtaagtgaattggctacttatgcattctcctgtagcaccaacaccagacacatttctcaatcctcctcccctggtaggacaaggccaggaacagactgtttccaccttccttacatcaatctgtcaggctgcggcaggtggctctgctggaaggccactgccctcgtccctggctgtccagaaaagtgtctttccccagttccagtgacgtcaggtggatgctgcacctgcagaggagagcagctgtctctgaagctggccctcgggtgacaaccccacaggcgatggtgagagcgaatgacgcttgtggctctcagagtgtggattacatgtggcaggccaaggtcttcgaagctctgaaataagcaagatcttctccccccaggcaaagcatagactaagccctgctctttcttccagttgagcaaggaggatccagaggctggggatgggttcccatctgacttggttctgaagcccatatcctgggagtagagttgccagcatggtgcctgaatatggtgtatggtttcccatgatcaagggtgaccaaagttttaaagacccaagaaagtgctgagtccagtggcctgatttcacttgctttattttttgctgagtactgaccttccgtcagggtttagggccaacttgtgtaggtagggtgtggggaggtccgcacctcgaggagcccagcatgggtgtggggggctcgtgctggctggttgcatccgtgcctgagctcagccttcttacacctttgcccatgaataccaccccctgcccccgcaccctcattttcagaaggtcccacccaggaaaggggaggtgccaccagctatggtttgggacaagctgggccctgcaaccagtgcttatagtggggagggggtggggagcgcaggggaaggcatgggtcacagtgtaccccatacctacccagccctctgcctccttcacctttgtcaccccactgtgtagttgtcacctgttcccaccgcgtctcccacatggcccctgtcagcctagggatcagcctgctatcagcacctgccgcctagtcctagccgcccactccaggggcctcctgctgcacttgcccttctcagagcagccactaccctgcagacctgaccagggtggagcatgtacagcctgcaccattgggaagacctggtgaggctcaagctgaattattctacatgctttcctgtgagttccaaaaatgtctgaaaaaactgaagaacacattgagagtcctcagccactcctctctcctccgtggatgcatttatttcactgtcttttctttccttcctgtctctgtttctcatggaggatgctgtgtcggccctcaatactgggggctcactgaccttcctccagcctcattcattcctcagatgagcagtcctgtctcagggctgaactcccctctccattaaattcctgcttctaaggagcccccagactggatcaggggctaccacattcacccacctctggcagcctgtacacatggatgcaataatcctggaagttcccaagaaggaaacccccactgtgtgttctcccaggcctcctggggtgcttcctagagcaggtgggaggagcaggaaaagtggcttcaccagcatctcttgatggctgttgatagaaatgttatgcagacgggtgggagtggggagggatacagagccaacgaggcccagcactctcctgagggctaatcttcggagtccctggcaggaggcagggagcaagtaatgaaggagcaacgcccagcaggagggagtcatcggactggagaccaagaaaggcccaaggaggcactcaaatgctgaaggaataaatggtgggctctggactttagttagcattccttacaatgtgttagacgagaaagggtctgggttcaaataggctaagaagtactgctcgcccccagttaaatgtgttcatctgttgcagagcctctcagagcctctctgttcattttcatcagaattgagaggaaaagttggcagtgagtaaagggagctgggaggcgacacgaggaaaggactttgtgggtcattgatccattgacccctctcctgtaaactctgcctgcatggccatcactcaaggacagctgaagggtggcctggaagggcctggaggaaaggtggtcattggggtggaacccaggacagtggctgtgaggatgtgggaggtgggtggccagtggtcaggacagggttctcccttggataaggcctgggccctgcgtggtcaccgtgatcagggcgggccagggcaccttgaagtaaggcaggacaaggaggcccggaggccatgagctgtgggagggacctgcgctcccccagggcttgcagagcactaggtgggcaaacctggccgaggcctcactgtggccctgtcctttggttctgggtatccctggcctttcccgggagggagaagcagcagcagattgtcctacctcggacatagcgggctccttccttccaggggcctgactgacctggcggcactcggggtagcctgctgggcgttgactcttgtcggctcctagccctggtctcctgggcaaacccctgcaccaaaagaagaaaggcccccaccagctccatcctaatctcgacccgcttgtctgcaagaggctaaaggagcctactcgactctcattctctgattttctgtcctcccctaaaacctcaggctcatccctggctccaagcccttcatcttctgctcttattgcctcccggcgcccgggattttgggctttctaacgccctccgcagcctgccaattctctatcacctaaggctgaagaactgcgtttgtgaagagggagtgcatggggccggggcggggctcccgtggagagggcggggcctcctgcggagggcgtggcctgagtgtagggtcgggggctgtgggcggggcggggcggggtctgagggccctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccaccaccgtttgcatatgggcctttccattaagaatcacgcgctccgggcagggccagcgcgctgcgggcagctccctaagaccccgacgggcgtaagcctctctgcctctctgtccagtctggcctgggacagacacctgtggacacctgaggcaaagggaagtcggggcccagggacatctcaggggaatagggtctcgggaaaaagggagaggctgggctacgaaggggagctggggtaggcaggggagcacagccctgcaggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcctcccccggccttttcagcggccgtccagagctcagcatcagcgctcctggcacagaccccactgctgactccattcactcccctacccccccttaagctatttgaacttctcacgccctccacctgcagggccgggttatgtcaccggctgacgtcaacagctgtagaggaataggagcaggtttccgttttcctctcccggcacctggccaaatgcccagatatgcacccactccctactgctgcctccttatggctgcccaccagccccactgagatcgaatggggagcctgtaaatcctgatgtcacccagtctcggggccgggagaagctctgagccaggcccccaaacctggcagggtccagggctgggggcaggtcaggggcctagcctgttctcctgctgcctgccatggctggctccaaggagggtggaggccacactccacacacttctgtcacccagcaggctctctggcctcagctcccactgggcttggacagtgggagcaccagcagggttcagagccacctggaagcagctcactctccaggtcccaccccatctgggagcagctctctccccaggtacccccgcggcagccgtgggggtggccttctctaccaaagcctgctccttgctcctgccagggccgtctctaaggcgacagccacacctgctgttgtcccatcaggcctcaaagaggtcacgtttccctgtcctttccagtctcctaagccccacttacgcctctaaacagactctaccgatgccccaggtcagtgttggggtcctggctggtgcagctggtgggtgtttgctctccttgaattcattctagtctttgacaagcatgcattgagcacctgttgtgtacactaggcctgtttaggtgccaggacaggaggagtatgacttgggtcctggcctgtgagaggccagggcaaaagcagtggggaggaggaagtggtggggagatttagggccccatgtgatccccagtaccccaattcatgtcccaaaacgaaaaaaaatggtaactcttggccatgttgtgcaatagtccctaatcagcaatgtcagctgaggacacgtccggtccacattatatttaatgatggtctagcactgtcattacccattttttaacaagatggccaagaaagccacccttgagggcaccagattgtcttcctgctgtttctgtcatgctctgcttctgcacacaggagacacactcacaggcaacatgcagacacacatacatgggagacacacagacacacacacacacacacacacacacagaggagcgaagcaggaactagaggctggccagctctacctcttctccaccaacatgttttgagtcccctcggacaaatcaggccccataaggtatggggtctccctccctggtggaggtcacctaggtggttcagtcaaagcccccagtggtggacaggccgagagcaaagaggcttctcttggtccctgtcactcctccctcctacactctcctttcccccttggccccaaagaccaaaccatctcttggactcagaggcctgtgaggtctcctgggggtctccaggcctggatgcacccagctgcttctcctgggcaccgaggctcccggcacgccccctgtgactgggctctcatctcatcttcacctccgtgtcgttcagcttgccctccacccatgctggtcctactggccatggaaagccgctgctgcaagacatccttcagtgactgtcctggctttgtgtccatgcccagacttagggggaaggggagaagcaccaagtcttcagcacagagtcagtgaggggagaggaggtgcttccagtggttggaaacgttcgatttctttttaagagtaagttttagctgataaattccactcccgtcgatatctttttccagagaacacctacggagataaggaggtgtgccccaccctgaggggctcggggagagagaacaagcaggaggctcagcttccccatctttgtgtcaacagccccttcagctctgccatcctttgtctaaactcactctcccgcactagagcacactgtcctagggggtgctgtgtctgctccccctacctaggtcccctgcaccccaccccacacccccacctgctgaatgaatgaattcagcaagtgaatgaacaagtaaatacccaatatttccttgcacaccttgcactttgcagaaaagagttgggtgggggcagttttaattcttctgtgctctctctttccatctataaatccctacccttgaccacctgggccatcctcacacagcccagggacacacacagggctggctgtcattcttgatacccttcccattgtatccttcctgtccagtggaccccctcaaaagacaggaaaatgactgtgaccactatgtaaatagggagagatgccttcaggagtcactgctgccttcaggagagaccagcacccatggaaaggagccctaaggtctctacgggtgtctgttttcatttggacaagtagcttgatgaatgcggacatgcagtggtaggttggaagtagaggcaagagcggggctgaaaagagtggacctgtctggaaagaagtatgggaacatcgggcatctcttggaacactgcaggaaggtgcaggaaggaacagcacagagcggcagcctcagcaggagcaggaggccactgtccactgagcaccttcaggtgtttgccaaagtgcaacatgcacccttccccgaaggctgcctcacactcggccttggagctccacggtgggatttggggaacacagagacgtccacagtgaaacgactccatgaactcagctggcagcaataggagcttcagatcacaggtgaccaggagaatacgtgcccctcaaggactatacaaacctgggggaggtgctgggttttccacaattccacccgacctgtaccctgggacacctgggagaccatagggaagtgggtgctagtgaggctactgttgctgccccccaggcccgtggtgagggcagggtgcaccatcacagccgttggccccattggcagagcacactcatatcaccccctgctgcttacaccagccttgtctgtactcaggaatagggacagcaatcgttcccattttatagatggaaatctgtgtcctgcggagaggacataattgactgtacctagtaagtggtgctattagggctgttactcggacccctgtcctgagcctggacttcctcctgccaggcttggagaaccccatcagcccacccctgcaggaaccaccagctccacactggcttcctaacccacaagcatcgccaaatgtccatccccccgccccggaaaacattcagttgcatctctatcttatacccttcacaaaatacattttgggtggactaattctcacatgcaacatccacagttgcctttatctaagtcttagagtcaaaaacaagaggataagtttataaacttaggttaagaatcttcttaattagcacacaaaaatcaataaatgaaaatagtgataaacttgacttcaccaaaatgaaaattttccgtatgataaaagattccacaaacaagcttgaagtctttctaccaaatggagaaataatttgccatgcgtacaagtggccagaaaatacaaacaagtcctaccaaccagtaggaaaagactaacaatgcagcgtgaggcacaggccaagaagaacaagggcaagcgcaaacacaaggtgggaggtgggcaagctcaccacggccatggccatggccactgagggatcctgagccacgcccaggtcagcactaagtttccatcagctggcaaatgttttgagttcataacacctgggaagggtgcaggagtggggagcaggtgttttcttcattgccagggattgtaaaggggtggagctgccctggggcttccaggcagtgcttactgatgtgccactcatgcacccaggagctggcacttccatcctcagactcccccaaggctcccccagtatacatgagagcaggtacacagatgcccagcagcactgcctgggaccctgcgtgaaaactgaaaggtctagaagcaaatgaaaataccatttgtaagaaaatggtaaaaggaaactatgtgcctatgtttgcgcacgtgcatgtgtgcgtttgtgtgtgtgcatccatgtgtgtacgcccatgccatggaatacaatgctgcaatgaggtggacaacgtctacaatgaggtagacaacgtctacaatgaggtagacacaggatgatctccaaggtcagtgaaaatgttccgtgcacaccagacccactgctcttggaatcaagataaacccactccctgccttccaggccctccctggcccctccttcactgcctgcccttgcccccagcccagctcctgggccctctgctctcctatggcctttctctgacctctcatccacctcaaggctgccacgcatccttcactctgttctccccactggagccggccctgaggccgcttcccaaagcagcctttgctaaccactgcccctcaatgtgcaccatgctcctcgctgaggtgagacaggtgcccaggggccctgtctgatcacatgctgctcgcacagcatgctctcctagctggcacctgggaggtggtgaacctgcatgaacatcagctagacggctaagtggtggcacatagattcggtgtcgtgtaaatgagaggcacagaaagcggtgctctgggctgggggcagggggtggctcacgcctgtaatctcagcactttgggaggccgaggcagtcagatcacaaagtcaagagatcaagtccatcttggtcaacatggtgaaacccactaaaaatacaaaaattagctgggcatggtggcacgtgcctgtaatcccagccactcgggaggctgaggcaggagaatcgcttgaatctgggaggcggaggttgcagtgagccgagatcgcgctactgcactccagcctggtgacagagtgagactcctcaaaaaaagaaaatgaaagaaaaagaaagcagcactctgtgtttctgtgggcacgacctgtgggctcatgcgctcaggaggctctagaggcactgacactcatctccgcccatgcctcctctggcctcatggacggtggcaaagtggaaacaattttaatcaaggtctgtatttttaacaaaaaatgtattaatgacttcggattcttaggacttgtgatttttcacctttacactggtgtgaccgcaatatgcactcggtagaacacgaacttcagatttggtgatatgcaatacaatgatcccttcagatgctgggcagtggcgtgagcacagctctcggccaacatatgactgcaggccaaacagctgctactccaggacgctgtggcgctggctgattctgcccaactgtaggtgaaagtgagtgctccaagcgcgcttaagcgggctgggctcagctgtgatgcttgctagattgggtggattaaatgcactctcaactcaccttattttcaacatatgatgagtttatcaggatgtaaccccctcaaagttgaggagcacctgtacagtaaatgaaaatataatgaggaaaagattctcctgctcagtcgctgtttactgaggtatgatctggggcgggaaactgggcttcagccctccaccacggccacccagagggccctccttgagcatagagaggggcttctcatcgggaaaggcaggggagacttcccgggtgacgctgagcagaaaccaataggcaggcaagacacaggcaggggtggcacgggaaggagagaggtggtcccagccgagggggagcgcaggaaaaccccagagatggaggaaaccaacgtgccctgcctcctgccctggatggagaggcccaggccctgaccaccaaggcaacaaaggcctggcccagcgcgtgcggccagaacttccacccctgtgcatctgtgagggatggaatctggagcaggacctttacaggaacccctgttcctctcaggaagggacttggggcttcctaggttgtctacaatccccagagcatccctttctcatgactgccatggccccacttggcacaggcctcagcctccttcccggtgctctgcggcctttcagccccttctccccttctgggccccctccagacttcagtgggtctggagacaataagaatttcctaattccaggctgcgggtgatggatgcagcccaccaggcccctgccacggggtcttcaggaagccatctcccttctccttggactctgtaattaaagctggggataacctactgtatttcctaattagcagccttaatccctcatgcacaccattaacaggctggcgcatctttagatgtgattggtaatgtcgttagcctaatccataatcaatacttggataattgcttccttgggtttatatttagtccttggggtcttgggctggggggaacatccatctgcagatgcactaatggctgtgtggaggtcgcccacggaccgctcacccaggacccccaggagctgtggcctgtggtcagagcaggtgctgccacagcaccggagacccaggccctggtgcatccagggatctctgcaggctgcggttgcgaagcctcctggtccatcaaggccttgggctctggttccagaacactaggggttatttcagaaacaaggtcaggagaccccagacctcagacctcagaccatggcagtgtccgcacgtccccaccccacacatccccaccctttcagaagagtctgcggggggtacagaggatggtcccagactagagctgcaggactgtcacagcctgcacattcctgctccacgcgggccccagcgcccctcagctccaggcacagcccctgtcctcgcctcccccgcttgccaggaaaccgtggcccagcccgacgtgatttcctttctctcaaaggctggcggcagctttggcagctcaaggacaggccagggcagaagaagagcagcctgtcgaaggcagcccttatgaatgggatctcatctgactgtaactggaattcgtatggaggctccgcttacaggaacttccccagcagacgaatctgggccacagagttctgagctggaatgccccaggagccagccataaatctccccaaaatgagggtgcacaatctcattgctctggaggtgcgctgcttgcccctggagacgacttgtcattctgcgtcctccaggctctgcagagagccaggagccgggccagggagaggtggatgggagttggcaaagtcaccgtgaaggtaaacatttttatcatttaattaggagcctctcagaaaagcaagctctgtttcgtctagagctggtcaaaggaaatgagaagtgacattttcccacccccacgttccccttggcccgggaaactccaagctggaggcgcgggatgtgggcagcctcaggctgtgcacatccagggctgggcccaggggcagtggtggggcgtgcagcctttgctgtgctctggccgtgcccggcactctcgctccctcatttgctctcataaacgccgtctgcattatcgatcaccctctgggtccctccataatgcaggggcttcaaaccgcacccgctccttgagggtgctgcattcctgtactctctgcatctcccaagcatatgtgtgacagcaagatggctgcagatatgcaacttccaataatcaatcaactcttaaatgatcctcaataaacccttaagtaatgaccaggagcccctcaccagcatatctgtacccatttgttgctccatccatcccaatgcatgactgacaagtgttcacacacgtgtcacccgcaggctccactccagctttggaggatgcaggcaggacgtcactctggggctcctgtctcctggggagatgacagtgagggagggacactcatgaagaacctccctagccagttcctgactctgcgactgcccagactctgagggtactgaccaacagagctcactcagctacacagagatgaacctggaggcctagaagaggccggcctggcctgggtgcaaaggccccaggcagaagagcccagatgtcctcacttctttcccagtatggggcacccaaaacatgcagctccattttaatgagcagctgctgtcctttttcagctgctatgggcccactctgtccaggctgcagcctctgggcagcctgaatccagccaccaggtgaggcacatgcatggagaactgtaagaacattgagacttcgtgcctcactttacagggcagcaaatggaggccagagagggcaagatacatggccagggatgcacaggagcaggatgaggaaccgggccttgctcccaccctgcactcggaggcccaggtccacctactacagacaaggagtccgtgggccaggggtgggactcatctgtgcacggagggcccaggctgttttttctcaggagggacaaggctctagtcaacactgcatcagggagggacagatgtcatctattcagcagggggttttagcagcttccttagttcttgggcttcactgggtccttctgccaacaagcatggcccctggccccgtgtggacactctcccagggcagaggccatggctaaccagcctgagctgctccagatagcccagcagagatatccaagcagctggagccagccagccctcagcacatgtccatttattcttgcagcagctacttactgggcctgggcggagacaagatgatccattctggatgcatatatatgaagaatataaagcagggctggtgggatggggacatcatgcaaatgtagtggggtgctggagaagtctgtctgccaaggtagccaacaaggagaagccagatgtgctgacagctgtctagggcggagagcagcagagcaaaggccctgtggcaggaatggatttgctgtgttccaggcaggagaaaggccagcatgatggagccaagtgagccagcaaagtgaaaaggccagagaagcctgcagcctggggcatgggttccattcccagtgcaggaaactgggatttgaagcaagggttggcatggttgatactttcagaagagtcagtctgagaggggccctggatgccaggctgaggaggtgggacttccttctggaggagaaaggaggaccaaagaggcttttcagcagggagctggcaggtcactctccagctgtgggagccagccccttctccgggagctgtgcgggtgctgggcgccatcaagacagctccgctcctcccagccgtgagacttgggacagagtcaccctctcaaattctgttttgttctctgcaaaatagacataaaattttagacaataaccagctactccagccaaacaccatataaaaaatggtggcttgttcccactcacaccatcaaaggccgagtggggagcctggacttccaccctggccaggctgtaatgagttgcccaatctccctgtctccctgatgagtggtatcagagagggctcagtgaggggccaggaccttcatccccaccaggcagtaaccagccccttccaccccgtggtgtcagtggaggctgcacagggagcaggagccttcgggggaacctggactcctactcccaccttccacactgtgcctgccagagtggtgtcagaagccgccagctaaaccagaaggtttcaactcacattcagaatttcataacatactgcacaaataacacaatacaggagctcagcagcagcatggggggacaaaggaacacatccatgaactccaagagaaactatagaaattatttaatctgaacaacaaagctacaatagattgaaaatgaaaacaaaaagaacaatccctcaggaacctgtgagactgtaacaaaacatctaattcatgttattgagtctcagaaggagaggagaaagaggtgggccttaaaaaggactcaaagatacaatggttgaaactccctaaatctggcaaaagacacacacttacgaattcaagaagctgagttactcaaataggataaaccaaaaaaatccacaccacgacacatcacggttaaactcctgaaaaataaaaacaaagaaaaaatcttaaaagtagttgggagagaaaagaccccttcctacctatagggaaaaaaaataagaacgacgacagatttctcattagaaagcacagaggtcaaaagtggcacatttttcaagtgctgaaagaaaataactatcaactcagaattctatttccagtaaaatattcttcaggaacaaaggaaattaagatattctcaaatgaaagaaaagtaacagaatttgacaatagctgacctaccctagaatgattaaaggaagttctctaaacagaaagaaaatattaaaaataaggaatcttgaagcatcagaaaggaagagaaaaacagtaggagtaaaaaatattggtaaacatttccttctcatttttggttttctaaattatatttgaccgttttcacaaaaattatattgtctgatgtatttctgaatgcatgtcgagaaaatatttaagacaattgtattacaaatataggagggtaaagtagcttgaaggggcatgagttttctgtactctacttaaactggtaaaatattaacatcagtacactaaattatgtatatataatgtaatacatcaaatagccgttttaaaagctatacaaaaagacacactcaaaacacactataggctgggcatggtggctcatacctgtaatcccagccctttgggaggccgaggtgggcggatcacgaggtcaggagatcgagaccatcctggctaacatggtgaaaccctgtctctactaaaaatagaaaaaaaattagctgggcgtggtgtcgggcacctgtagtcccagctactcgggagactgaggcaggagaatagcgtgaacctgggaggcagagcttgcagtgagcggagatcgcaccactgcactccagcctgggtgacagagtgagaaaaataaaaaaaaaaacactatagacaaatcaagctggaattctaaaaaactttaaataacccataggaaagggaaaaaagctcagatatactaaaaatagtgagaacaaacagaaaaccaaaacaaaacataaaatggacaacttaagccctaacatgtcaataattatgtgaaaatgcaaatggtctaaatataccaattaaaagacagagatggacagaatacactaaaaatatgacccacctatatgctgtctataagaaactcacttcaaatataatgatatgtgtaggctggaagtaaaatgacgggaaaagataccttacacaaacatcaatcaaaaaaaagaaagcaggaataagtatattaataccagataaagtatattttagagcaaagaaaattgctggagacagaaagggtcattatataaggatgaatgggtcacccaccaagaagtcatagcaattctaaacatgtatgtacctaacaaaagagccaaaaaatatgtgaagcaaaatctgatcaaactaaaatgagaaatatataaatctacacttctttcaacaattcatagaactactattccaacatagaactactttcaataattcacagaactactaacagaaaattagtaaggatatagaactcagcaacaccatcaaagaacgttatctattcaacagatggagaaaactccatgcagcaaaagaagaatacatattcttttcttttcttttcttttcttttttttttttttttgagatagagacttgctgtgtcgctcaggctggagtgcagtggcatgatcttggctcactgcaagctctgcctcccgggttcatgccattctcctgcctcagcctccccagcagctgggactacaggcgcacaccgccacatctggctaatttttttgtatttttagtagagatggggtttcactgtgttagccaggatggtctccatctcctgacttcgtgatctgcccacttcggcctcccaaagtgctgggattacaggcgtgagccactgtgcctggccaaatacacattcttttcaaatgcccgtggaacatattccaaaatagactgtatgtaggccttaaaataaacctcaaaatttttaaaacaattgaaattttgtagagcatgttctctgactgtaatggaattcaactagaaaccaacagtggaaggataataagaaaatctctaaacaattgaaaacaaaacaacacatttctaaataatccatgactcataggaaatctcaagggatatataaacaacgttagactaaatgaaaagaaaaatgaaaatgcaatataccaaaattagtaggatacagctaaaatagtgctgagaagatggtggatagcactaaatgcctacatcacagaagagggaacatcttaagtcattaatctatttttacacctcaaaaatctagaaaagaagagcaaaataaacccaaagcaagcaggagggaataataaaaataaaggcagaatgaaatttatgaaattttaaacagagaaactatagataaaataaatgaaacaaaaaagcagattcttttaaaagatcaataaaattgataaacctttagcaagactgacaaagaaaaaagagaaaacacaaatcattaatatcgtgaatgaaacaggatatgactgcagaccctgaagactgaaggaaatcaagagaatactatgaacaactctgcacacataaatttgacaacttacataaaatggatgagtccctccaaaaccaactacaattcactgaatgtgaaataaatagcctatagccattagtaaaattgaattcataatttaaaacctcctcaaaaagaaatcttcaggtcgagatagtatcactggaaaattgtaccaaatgtttaaagaagaattaacaccaattctacacagtcttttccagaaaatagaacaggagcaaatgcttcccaatactattggtagtattaccctgacacaaaactaattctgtcttagtctgtaaccgactaagaaataaaaggaattcagactgggaaggaagtaatagctgcccctgtttgctaatgacatgattcatctgtaacagactaagagagtgttaaaaaagaaaaccataggccaatattcctcataaatatagatataaatattcctaacaaaatattggcaaataaaactcagcaatatataaaaataattatatgccatgatcaagtagggtttattccagggatgcaaaagcagttccaatatgtgaaaatcaataagtgtaatccacttgataaacaggctaaagaagaaaaatcacataatcatattaattgaggaagaaaatgtatttgacaaaattcagcacccttgagggatgggggtatggggaatgactggctgtttaacagtctgggcttccctctggggtggtaaaaatattctggagctagacagcggtgatagttgcacaacattgtaaatgtcctaaatgttactgaatgtacagtttatactgcttagaatggtaaattttaagttacgtgtattttatgaaaacaaaaaattaaattcaatacctattcataaagaaactcagaaaaataagaactgaggggaatgtcctcaactcaataaagaacattgacaaaaacctaacatttaacattatacctactggtgaaagactggataatttcctcaaagatcaggagaaaggcaagggtgcttctcttgccacttctgttcagcagcatcctagactttctagacagtgcaataaagcaagaaaaagaaataaaaggcattcaggctggggaggaagaaataaaacttcccctgtttgctaatgacatgattgtctatataggaaattctaagaaatttaccaaaaaaaaaaaaaaaagccaaaaaagcaaaaaaccaaaaccaaaacaaaaccatcactaataaataagttcagcaaagtcttgggatatgaggtaaacatacaaagaaaccggtgaatttctatacactagcatgaacacagggacactggaattaaaaattacagtaactaaaattgatgaaatacttaggtataattctaacaaaacatgttcaagacttatatgccaaaaactacaaaatgctgatgaaacaaatttagagaaattttttaaaaatctagataaatggagagacttactgtgttcatggattggaagtctcaacataggaagatatcaactctctctaagttggttttcaggtttaacacaatttctatcaaaatctcagcaagattttttgaagatatagacgtcattctaaaatttacatggaaatgcaaaggaactggaatagctaaaacaattttgaaaaaggataaagtgggaggaatcaatctatgtgattttaatatattatttagctacatttatcaagactgtgtagcattggtggagagttagttacatagattaatggaacagagtagagaacccagaaataaacccacagcaataggtccagctgattttagacaaaggtgcaaaaataattcaatggagcaaagatgatgctggagaaatcagacagttgtaggccaaaaccaaccaaacagaaacctgaaccttcacctaaatctcacatctgattttttaaaattaacttaaaaaggataatggatttaaacataaaatgtaaaactataaaacttttagcaaaaaataatagaaacttttcaggatttagaactaggcagtgttcttagatttgatgccagaagcaaaatccataaaaagaaaaattgataagttggattcatcagaatgaaaaccttttgctctgcaaaagatcctattaagaggatgaaaagacaatctacagactgggagaaaatatttgcaaaccacatatctgacaaagaaatagtctaaaatatgcaaagaattctcagaacaaaacaacaaaaaatccaattagcaaacaggcagacgtaaagcgatcttttaccaaagaaatggcaaataagcacataaaactgactgtcagcaatgtgtaaactaaaaccactacacccttatcagaatggctaaaataaaaataaaaaaatagtgacaccagcaaatgctggcaaggatacagagaaactggatcattcatgcattgctggtaagaatgtaaaatgataaaggcactccagaaaacagtttgtcagtttctttaaaaactaagtatgccactaccatatgacccagtaactgcattcctggcaatttatatcagagaaatgaagacttatgcttactcaaaaatctgtacataaaagttcacagcagcttttttagatagtagttgaaaactgggaacaccccagatgtcctttattgggtgaatggtttaaacacactatggtacatccataccatggaatactgctcagtggaaaaaaggaccaaactcttgttacacgcatcaacctgggtgagcctgcagagaatcatgctctgtgaaatcgccagtgccaaattgttacacactgtatgattccatttatataacattcttgaaatgacaacattacattaaaatggtgcaaaagtaactaaggtttaatagaaatgcagactaggttagcttaatggctcccaggggttaagggcaggatggggttaggggcagggaattcctctccttgagggagctgggagggaagtgggtgtggctataaaagagaaacgtgagggatcctggtggggaggggatgttctgtctctccacagtatcaatgtcagcatcctgattgtgacattgtagtatagtttgtgtgtgtgtgtgtgtgtgtgtgtgtgtgtgtgtgtggttttttttttttaaaatggactctcacacttgttgcccaggctggagtgcagtggcacgatctcggctcaccacaacctccgcctctcaggttcaagcgattctcctgcctcagcctcccgagtagctgggattacaggcgcgcgccaccatgctcagctaattttgtatttttagtagaaagagcgtttctccgtgttggtcaggctggtctcaaactccctacctcaggtgatccacccgccttgacctcccaaagtgctgggattacaggcatgagccaccatgcctggccaacactgtagtatagttttataagatgttacctctggaggaaattaggtaaaaagtacacaagatctctctgttttatttcgtagaaccgtatgtgaatttacaattattcaaaataaaaagtttaattaaataaaaaaatcactaaaaaaagttgcctagaagatttaacaaaattaaaccaatctgtgaatttaatgacataaagcatccaactttattgcttaattgttaaacttcatccaagcaatatgtagacattgcctaaaatatttcaacatattacaaggtttataaagaaaagtggcagtcccctgccctaatccccatccctagaagcattccatgtgagtctgttggctgttccttctcacgtttacttttatgattctaagtaaaatgcttaggctgccggttcttggtttttccattttagtgttaaccgaatgatggacttcttcccagggtaaataacagtcctgttcccttacacatcccctccaaccgcccccaccccacacacacatccttccctctccacttccttccaatggagttagatcatgatattgggtcaaattaatgttttatttttaacacttggctaagtaaatacccttcacagctgagtccgaccgttttctagccatccgtatcgtatattcatgcaataaatggttattggcacccaatgtttgccgggcactgttgcaggtgctggggacacagcactggaaaagcaaacagggtcctgtcctggagaagcttccatttttgaggattgggagaccaataagaaacaagttcaggcatattttttccggagataagcaccaaggaggagccccggacggggtgccatgagcaggggtgccctagggaggcctgaggagaagaccctgccaggggctgaggggagaagaggggacttgcgggctcctagaggaagagctcatccaagcaggacggcagaagcccaaagtcctgggagtgagctcgctgtcccgaggcccaggtgaaggggctgatatggttggggggagtccagctgagtcccttcttgccacccggggccccactgccacggggcgtcactcgcttctcttattaatgccgtcaccaccccttggcttcagctaagtttcagctttttccactctgaagccagcacctctcatctgttccgttctacccgcagcgttgccctcgtcctccccccaccctccgcctcatgggcgcaaacactcgggagcacacgtggagggtggaggcggcacagagacctccccagggaaatgaggctccagctggatttgaacacgcggggaggaggtgaggatgctgctttcccaacagctgggccgcctcgtccttgtcaccgctctggtttctcagcccaggctattttgggtcaggctgcgaggaccgctgcgtcagcgagtgggcgtgagtggcggcgcctacctcccccagttgggccgggcacagtgccaggccaggcccacccaggctgcgccaggggccgccagcctctgggcggcagggggacccctggaaccagggagagtggcctgagcaggaaatcaggtcccaggtaacacgggcttcagcgggctcaggctggggaggggacaggtgtctcggactgcgggcggaggaaccgcgcacatcagagggcagcgtctcagggcgggctgggatctggggagggattcgccaggaggggtcagtggcccaggccttccaggctgagtggcgctgggcagaggcacgaccaaaggcaggaggctctgggactatttagggaggagggaggctcaccgaggacacagaggccaggctgggaggtggccaccagccaggggcggggcagcaggtcagggagatcggatttccccagctcccactggcccgcgccttgcaagccggagatttcccctgctccgtggaaccctaacagctactctggggccttgcgccccatcccaggaggcccaccccctctcccggccagttctaccttctctgtctcagcaacccccacccttgcgactgaatgaagcactctgaacagagaccttttgaaaaaagtctaaatgtccccttcttaggtgagggaagcaaaagggaaaaatagaatcgacaccaatgacctattccagtctcccctcccgactgcagaaaccagcagagccacatgggcccacaggcggggcaggcccagctgcaggcaccaccctcctccctgtcctgagccgggcttgctctcagagcctgctgctgtccccaggctagggatgcgcctcccagcgggaacccctgtggagggaaagccccgcccagcccgaagctcagtcgcgaggaactgccgtctgttgagcactgccaggtactttttgactcatgggtcgttttgctctaacatgtgtatcccttaaaactcagaagagagtctggtcttgtttactcgcggttttttttgtttttgttgttgttgcttgtttgtttttcttttgaacaaggaggaagaatatctataggcaggaagtccccaactgtcctagtccccaggctgctattaaaaagtaccatagactggggacttaaacaacaaacacgtctaacagttctgaaagctggagggccaggcaaggcgctggcagatccactgtgcggtgaggcctctccttctggctcatccctggtgccttctcctgtgtcctcacgtggtgggcaaagcagctctctgaggtccttgtgtaggggcaccaatcccattcaccagggcaccgcccctgtggcctcatcacctcccaaatgtcccatgtcttaatgccatcaccatgtgggggagggcttcaacctgtggatttcagatacacactaggcccacagcacacactcaggctgaggcctgctctaccatttccgcagacccctctggacccgtcgcggtgctagtctgcagctctgttcagcacctgctgtgctcggccaggctgagggcagtgggtgggcgaatactcctgttccctcccctaaagctcaagcaccccttccagcaaggttctgctgtccctctgtcacaatcaagggaaaacgaggtactgagggtcccatggcacggccccgcagccaatcaccaggactaggcctgggagtcagcccccagctgtcatgcctggaaaccctgacctcacttactgccaggcccagggagggctgtcacttccctgggaagggccctccatgctggggacatactgagagtgccgactgattcaaaagactggaggagggatccaaggcaggaggcctcctgagggcctgaatggccacagactgtaggcacagggatggagagaggatgctgtgtgtgggcaggtcagcgaggaaggttggtgggacccatgggcctaagggtgaggaagagtcaaagatgacttgaggctttccaggggcacaaaatagaggatggtgaggccatcagggatggggcaagctgtagagggtgccgtgaggggctctggtggcggagacttgagctttctgagtctaatgaaagaaagagaaattggagagaagggccccaaggggtactgacctgggccgggctccagcatccagttcctataggggctatgaaggcctgagattagggtccgtctcaatttcagggggatttctctgctgtggccaaagcagcctgaagctaggccaggagttttgtctcctcactgccttttctggagtgccttgtagggattaatgcaggagggaaacccggttgatttcaggtgtgcaggggtcttgggggagaattctgggtgaggagcctacaccatttgtcccaggtgcagcttcgcccaacacgcacaggctcagcagggctggtcaggaacgatcttgaactgtcagcaccctcaatgagcctttgtatgaactggaaacagacggtgacactgaatcagggtacaccggggtccaggactgggggtggtccctggagggatcacagcccccctctcacagggcatgacccccatacctgcgtgctgtgcccctgaacctttgggtcccatggggttaccaagcaagcactggctcccagccttgtgacttcaacatggccaggagcactgtgcaggtggcctcagagaaaaggggcgggagggcccagacttttgctgggcaccccacctcccaggagagggcacctttctttttctgtgggaggatctgcagctgtggggcagacccccagccctcactagactgctcgggtttcctggaggctccgggccaagctagcctgagtgcggaaggtggcaggtgccccagatgcagtgtgctccatgctctcggtggctgtggccttcctgcgtgtgtccccatcggtggagtggcattggcacgctcctcacctgctcgcccacaccattccagccctgatgattaattgtataattagctagaagccacatgttgctcaggttgaatttggtctaaaaatattttcttatgaaaaacacagcagaacctaaaaatatctcctccacagttgcccagggaagcctcctgcttgggccacccccagccatccctagctgcaactcagtttcttggagagtctggaatgcagaggcagagggctggccaggcactgcttcccaccagggcaaggtgagctggggtatcaagactgtccctggcattgccagttcccacaggctcccaatgcctacagtaggtcagaggctgctggggctgcctgggaggctcctgtgtgcatacaggatgcatgccagcctgacttcacgggggctggggcagtgccacagaggaggcacagacctcgtggggtgaggtcctggaaagggcttcctcaccctggtgagccatcagggaaggcctgcaaaggaccagtgctgagctgggtgggaccctgcacaggcagaactccctgctgacctgtgcaggggagtaagggatgctggaagaagacactggccctgccctagagcccctaaactgagcattgctgcggctgaggcccgtgcacctggtcccatccctgcatagggcttggctgactggctacatgtcctgtggctggtggggacagacatgagcagggacatggagcacctgtatcttccaggctttagcacacagaagcaaccaccctgctctggcacacagttctccctgggtgggttagtcacaggggtcaagaacttaccatcttgcccttctcctcttcccttttggtgtccttaaatgggggccaccatctcctgcttcggaggctctgccttggtctcaggagaggaccccgtccacctggcctgtctgtgcaccttctatcccatctctggggtagatgatgaacccttagtgcctccactccctcctggcccagtggagccctggagcacatttccgggcccttctctctggtcccaggtgggtggctcaggcccagagagcttggcccctctggatggacacagaaaggtgggggcacagccaggatgggcactgccttctcctaagcaagcccaggtgcatggatggagcaagtgggggctccctgcagccccatccagccctgagtctcaggcccagggtggtgtggcagggatttggactgagtgtggcttgcagagggcacacctgcctggggacaaaatctgttaaccccaggtttaaacaataaaggcactaacaatctaacctccagagaatgaggaggtgggcggctccaggtgcctgttgcagttaaaccccatgaagcctggctcctgtctctacagtcccctcaccttccttcatgcttcaaagatggctgctgcagccccaagcatcacacgtatcacaaagggaagagatggcaccagcaaaatatcttcttcctcctccctcgtttttcagaaagccaaagccctcttgccaatagcttctccttgtcttgactgaactgtgcccacggtggtcacatggccactactaactgctagagtgtccagtgaagccagtgcctgacaagggagagcccagctgctataactggactggaacaaacagaattgcagcctctgaagctgagcacattgcaaccccaaactaaagcaggtgctgaaggcaagaagaggttgggagaatgttttccacaggagaaaacttcatccttgtgatctggggaggggcaaagtctgcgaggagaggctctgccttccccccaaccaggggcccacatttccatctctgataaataattggtaggtgtcgttccctggagcagatctgtaactcactgaggggaccttccaagctggttctgtgttaaatacacaaatcttaccacagcctttctgacaatcaggcatccaggccctgctagatccctgttgaaaggaaactcatcacatgtcaggcagcccattccttctggaggcttctctgacaggaaccacatccttattttgagctaaaatgggcttcccttggcttctagtcattaaccctagtcctactttcccacattttttttcagcaactttctgtgaatctattatttcaaaacacaaaattaaaaataagttaaggagagacacaaaaagtctaagaagtgcctgaattgtacttctagagatgaacattacaatgtctgagataaatagtacactcgatggcatgagcggcagattagacattacaaagtagcttagtggactagagacattgccataaagactacccaaaatgagccacacaaaaaattaggaatacaaatgaatgtaaagggcatcagcaaactagggagaaatccgcaagtagcctaatatatgttggaattgtagtgaccaaagaagtgtgggaacagaaaaaaaatatttgaagaaatagtggttgaagagtgtccaaactggatgaacactttaaactctagtgcaagcatagccaaccacaagcgcaagaacaagaagcaaggagaaaactaaccaaggtgcaatcatgatcaaattgcttaaaaccagtaacaaagaaaacatcatcaaagcagccgggaaaacaaggacacgtttcatcaagaggaccaaagagcatgaagataagagatttttcaccagaaacaatgcaggcaagaagtcagtggagagacatcattaaagcactgtctgtacaaaactgtcattggaggattgcatacccagcaaaaatgcctttcaaacatgaaggtgaagttgaggcttcttcagacatacagaagctgaaatcatcagcagatcttgtctgcaagaaatgttaaaagaagtccatcaggcaaagtgatactggatgaagatctgcacttacaaacaggaatgaaaatcactacaggtgagaactacacaggtacatttattatttaggtctctttaaaagaaaattgattctttcaaaaaataatatatagtggggtctgtgataggtaaaagtgaagcgtgacaccaatagcattgacaacaatagaataagggtggggagaagtatctcactataaaaatctcagactatgctaaagtcctgtgatgccaagatcgcttgaagggattgtgatcagttaaagactcacactataaagcttaaagcaaacactaaaataacaaacaaagagttatagctaacgagtcaaaaaaaaagagagctaaaatgtaatcacgaatacttgattaatgcaaaaggaagacagaaaaagaggaaaaagaacatgaaaaccagaggtgagcagccaccagaaggcagaagaggcaagcaatggatcctgccccagagcacccagggggactgtggccctgccagcaccccaatttcagccccatgatgctgattgcagacttctggcccccagaactatggcaagataaatttctgttgttttaagacaccaagtgtgtgatttttcttacactagccacagaaatgaatgcattgtatcaccctgggaggggcaggccaccaagtctcatcatcccctccaactctgtgtcataaagtccagacagtgctgctgagaagttagggctcctttcttctgcctcctgaatcatgagtggaggctctactccaggttcggggggctgagaacatggaggcgctgactactctcacccagctcactcacagggtataggttccacaccagtcaagtcaagtgaaaaagatcagaggcttccacccccacccagtgacaagaggagtgttgtagacatttttctcaggggtagaggctactcaggagaacacaaagctccaaactccaaaggtgtctcttgaagactgaggttatttgaaatagtgtgggtaaattcaagtctaagggctatctcaaaaacagtggagattttattagcaggcaaagagcaggctgatcactctgtgggcaacaagccaactgtaggccagtgagtttaccaggaagaaccaagaaaagagccctgctgggaccagaaaagaatccaaatattatctctgtctaaaattaattttatcagactagaaaaatgcatgccccaggacattatcaaaatggtttatggttttgtttctgaggcacttgtaggtcctgaagataattgtacatattctcttctaaaaactttatatttcttttacatgtagatatttcatccttagaattgatttttgtaaatggtatgaagtagggatatagttttagttttttccacatggatttgcagtctcctaaggaccgttgattgaaaaatcagcctgttcctcactgatcacgcacacgtgaagtatacagattgtggggtttgtttctgggctctgaattctattccttggcttacatgtgtagttagttatttttgtctgcaagcatttcattttaccttggagtattatttgtgggttcctccagggacgatttgtcttccatctttccagtacctgggacaccaccactctgtctcgttgaaaattgaactgccagcttgaggttttcagaccacctaaatcttatgaattcaggctgaaaaatctacatgaagaccactggcttctgttgataaattctcagcagggattttcacctctttcctctcggcactgaggttcaaaatggctggttttctttgttatacccttgagaaaggcagatttatttccagttgaccctcactttgagcagacagctgattggggtctcagctctgtggggatttcccacagaaatctgggcctgccatgggctttgacttctgccctctgcccaccaggaagtcacgaaactggaagttcaacttcccgttgctggcaaattccctcaggaatttggcttgccttttgggtgtctgtattctacaaatgttttgacttgagaagttcttgcttttggctaaatctttaatacgtttttaaaagactatttataaaattttgtccaggttttcagtgcaagagctgatccaggtacctagctcaccatgttatccaagtgtccagtacaacccaatttttaagtttttaaattgtataattttaaaattatgaagtgtgttttgtctttaggattttgaaagatctgagagttctgtcttatcctgagaggtaactaatgtcccttccttccaactcttgcccctgttacctgagtccacctgtagcaggtactttaacatacataacgtgtgacctgctggtgctggagtggggttcacttcacttccacagtggcctctgcaggggcagggagtcctggagccctccgtgtcccagaccccagttctgactttatttgagtcaagagcctctttaagaatctgatgaggccggctgcagtggctcacacctataactccagcactttgggaggctgaggtgggaggatcacttgagcctaggagtttgagaccagcctgggcaacatagggagaccctgtctctacaaaaacttttttttaaaattagccaggtatggtggcatgggcctatgatcccagctattcaggatgctgaggtaggaggatcacttgagcccaggaggttgaggctgcagtgagccatgactgcaccactgcattccagcctaggctacagagtgagattctgtctccaaaacaaaacaaaaaaaattctgatgaaagctagacaagggcgtacagaacacacacagcagacacagtttctgttggatacaccttcagggggcctgtggatcccttgcagtgggatcccctaattctaagaccccccaccccacgcctctctatagcacttccctgtgtttgctgctggcaggacaggaggcagcaggggctagcacaggccagcctgctcagctgtgggtgttctgcagcgaacctgctgtgcctgtgtcacataccaagggcatgactaagggctactgatgcagagtcagaagtggcccagccctggcccctacctcctcccaggctcctctgagcctcagcagagactgtggccaagtagtgaagtctctggcggacatctggacctgcaagccatccagagcattgtccttggcagtggcgagatggtcaggtcagcacctgggtccttcccagcttaggcacactttttgccaggataggagcttctcaggccagggcctctcttgccagtgcaggcagtcatgcctggcatcaagtccagcaggcgcggaggggactgcaggccacagctgttcaagtgggggcctcctttctgccctgcgaggccctctcagccttgatgagatcacttgggggccttctatctctgggactccagaaatagagacagggaactgggagtgaaagcagccacatgtgcttgggcaccatgagtgctcacaggtgccagaggagcagacgggaccaggtcagggactgcagcccaggaccagccagtggggcttctgcagtgcctcatcctgttcctgccatgcctcactgccaggaaaacagccacccttgaccacctgcccaccggcctctcccaaagaagacactccgagaagcaactgctagaattttctcaggactaatagcagttgctaactgtctccaaagcacactcagctgtccttggggctcagccagccccacacataggagggacaaggcccacagcgcacaggctcagctccacagcacagggcttctgtcctgaggccccgtaagcctccttccagcatgcctttctgttcatggagtattcactttgtgattgtgtaatcaaaaatcgtcttgacaatacagcattctcccatactagacttactcagagatggtctgtgctctgaggatgatgctagcatggctgctgcctgggcacctcagagcagtcctgacacagcccccatggagccccacctcgaggagaatgggatagcctggggatcctgggcccggagtgggccccacgtgagtccagcttgctccagctgactctctgtgggcctccattttcttgtctggaatggaaggaaatgatccctccagctcataataatgatcatgtttatgtcagatcatcgttcctaggatttccccaaacctccacgtgcctgggagaggagtgagttctccagctccctgggaccctcaggggttacacacaccaccatcggccctcccataaaggctgcaccttggctcggcctccactgtgggcctggctgcaggctctcaccccagctggtaggagctggggtgaaggaggccagttcaggcgagtcctctgcaccatcctctgctggcccgatttcccgatcagcactggatcagcctgagtgcctgaatccagagctcactctccacttgggtgggagcatggctgcttcctgtcagccccagcggtgtgactgggaccagagagtctcctgcagcctgaagaattgtcccagcctgcccacccccggcctcctgtgctccaggcaggcgtggctctccgtgtggcagatctcactctttgtcagggcctctgtgtccttcctcctgggacaggcttggcctcagagggtgggagggaagggagggccactgcagccgcagctgctgcatcaggaggggccaggagtccccaaggtcgagtccagagcgcagcagggagtcccagtgctgacgctctgcacatgtggcgtccttgtcttgccccagctgcaggctccatgtccaaaagcacatggagggagagcagaggtttcctggggacagcagctgaggccaggggctggtgtgctggctcacaggctctgaggctggggatcactgacattgtgctgctgcggcctcctgcccagggagcctgctggcaaggggcccactgcgacccgggctgcatccctggccagccctctctcactggaggcctggactcacccctgccaggaggggagctctgtgctccctctctgctctgtgctccctctctgctctgtgctcccttcctgcctgtctggcagcacagtgaccacctccccaaaacccatcccggcacggaagtggggcctcagagcaagcagaggaagaaccaggggcccttggtgatacagcctggagggggccttggctggcacttgccattggtgtcgggcagacaccggcccctccacccaccagaagatctcaggcacacctgcccaccctgaaagcaagcaggcagggagtggcccccagagctgaccagagggagagaagacaggaactgtagagacaagaggagtccaccgcccagcctggggcagcaccttggaagctggggttgggctatccaactagaagggacagaagccagctgtgcggttggttggtggtgggctggaaaggggcagagggactcaggacgtgccttctgatgggatcatagggtctccataatgcattggccacaggtggatgaggaagaagttgcctcagggttgtcgtggaactcccaggagggctacgccacccccatgggtgtctccaagccccacgccacctggtttgcagaccatgggcccctagtcatgtcgcctatctgggcctttttttaaaaaaaaaaatttattttgagagaattgtagaatgagcatacaattcatgcatgcacttataagaaacgatacagagaggtctgaagtaccctttacccaatttccttcagtgataacatcttgcaaaactacagtacggtatcacagccaggatactgacatccgtagagtcaagttacagagtattcccttaccaccaggggccatccgcagccacacccacttccctccctccctccccagcccctccataacccctggcagccactcaccacttctccatttctacagttttgtcatttcaagattgttatataaatggaatcgttacattatgtaacctcccggcattggctttttttttcactcggcccagatccctgtagatccatccaagttgtcccatgtaccagcagttgattgctttctaatgttgagtaggattccatggagtggatgcactatggcttgaccattcacccattgaaggctctttgcagagctctcggttttgggctactgtgaacaaagctactatgagcttttgtgtacaggtttttgtatgactacaagtcttcatttctctgagataaatgcctgggagtgcaattgctgggtcacatgtcagttgcatgtttagttttataagaaactaagaaactgttttctggagtggctttaacattttacattcccaccagcatcatgtataggtgatgcagtttctccacatccttaccagcatgtggggttctcactgttttttattttagctatgttgatgtgtatataatggtatctccatgcaattttaacttgtatttccctaatgagtaatgatgacaaacgtgttttcatgggtttatttgccatctgggtatgctcttatatggaataactcttcatatcttttgccagtttcctaattcgcttgtttgtttactactgcattttgagagttgtttattctagatgttaaaagccttcatcggatacatagtttgcaaatattttctcccagtctgtagcttgtcttttcattcccttaacaggctctttcacagaacaaaagcttctaattttaagaaagtccaattgttttttacgtcaattctaacaacgtggctagttctagatcccgaaaattttctgctattaagaaaaaaaagctttatagctttacatttacacctaatccattttgagttagtttttgtataaagtgtgaattcattatttttgctgtgatgtccagttgttcccgcatcatttattggaaaagctgtccctcctctgatgaatggcttcatacttttgcggaatattaggtgggcatatttgtgtgagtctatttctggggtccgttgatctatgtgtgtctgtccatctgccaataccctactgtcttgattagtaagctttaatttcaaatagtgattccttccacttattcttccttctcaagatgggttttgctgttctaggtcctgtgtgtttccacataaattttatggaaaaataagcttgtctatatccacaaaaatacttgctaaaattttgacagtaactacattaaacctgtagaattttggaaaaattgacatccttatatgttgagtactgtacatgtttttttaagtttataatgaagtatttcattgtttttgaaatgactgtaaatgatattatatttttaatttgttttcacaccttcttttttaatgtatagaaatggattgatttttgtgtgttgatcttacatactgcaacttgctacactcacttattagttcttttgcagattccttgggattttctacagagactgtcatgtcatctgcaaatacagacagttaatttctttcattccaatctgcatgtcttttatttctttttcttgacatattgtagttggtagagcttgcagtagtctactgcataagagaggtgagaatggacacttttccttgtaccaaatcgtagaaggaaaatattcagtcttttaccattaagtatgttagctataggtttttacagatgctctttatgaagttaagaaaattctcctttgctccaagtttgctgagagtttttatcatgactaggtgttggattttgtcaaatgcttttcctgcgtcaactgatagaatcacatgacttttcctctgtagcctgttggtaggtgtattacattggttggtcttgtaattctgaaccaaccctgcatacctgggataaatcccaactgctcatggtgtataattccttttaaatgttgctgaatttgatttgctgatattttgtcaacaatccttgtgctgaagttcatgagaaatgttggtctgtacttttattatcacatgttgtctttgtctggttttggtatcgggcctagcctaataaaagtgttctttcctcttctattttttaagacggattttgtaaaataggtgttaattcttcataaatgtgtggtagaattctccaacgaagccatctgggcctgaagatttcttttaaatttcacattcagtgtgtttaattgttataagactattcaagttgcatgtttcatattggttgagttttggccatttgtggtttttgaggaattggttcatttcttccacactgttgaatttatgagggtaaaactgtagcgttcctttgttgtctttaaaatggctgaaagatctgtaatatctctgttttattcctgatattggtgatttgagtcttctcttgttttatctttgtgaatcttgccagaggtttattttttgaagaactagatttttgtttccttgtttttctctattgttttcctgttgtcagtttcatcgactgctgctctttattatttcctttgctctgccttgctctgggtttattttgcttttctttctcgtgtttcttgggttagtaatttcgatgactgatctgagacttttcctcttttctaatgtaagctttcagtgctgtacatttctgtttcaggctttttcagggttttttcatttgaaagtggaaggtttgcatcggcacgcggaatagagaagacaggcgtgcttgagaatgggctctgccgcctctcagcctgctccctgggttggttatttcaactcccaggggttcctaatccagaacccggctgccgtgcacaaggctatgggtttctgggaagactaaggcccctgctcagagccgaccctcagcaaacagcctttcctctcgctcctttctttcctgctccagcagtttgattctgtgattaactttaaaataacatttattttacacgattacaaaataaatatattttcatggaagaaaatttggaaaacacaaaaagctatcgagaaaataatctatctgcaaaccttgccactccaccccgcctggacctctgctcactttggcaagcaccctcctgacttctttgacgtgaatttgtttttccataagttattggggtacgggtggtattttgttacatgagtaagttctttagtggtgattagtgaaattttggtgcacccatcaccagagcagtatacattgcaccgtatttgcaatcttttatccctcgtcccctcccactcttcctctcaagtccccaaagtccattgtatccttcttatgcctttgcattctcatagcttagctctcacatatcagtgagaacatacgatgtttggttttccattcctgagttacttcacttagaataatagtctccaatctcattcaggtcactgcaaatgctgttaattcattcctttgtatggctgagtagtattccatcatatatatataatcatatatatggaatactactcagtagtgtgcatatatatatatatatatagtattccatatagtagtattctatatatatatgtatatatatatatatatatatatatatatatatacacatatatatatatggaatactactcaatcatacaaaggaatgaattaacagcatttgcagtgacctggatgagattggagactattattctaagtgaagtaactcaggaatggaaaaccaaacatcgtatgttctcactgatgtgtgggagctaagctatgagaatgcaaaggcataagaatgatacaaatatatatatatttcatatatatttatttatatgtatctatatatgaaatatatttatatatagatatataaatatctatatacaaataaatatttatgtatatataaataaatatatttatatatgtatatataaataaatatatttatatatttatttatatatctctatataaatatatatgaaatatgtataaatatttatatatacatgaaatatatataaatatttatatataaatatacagttatatattatatatctatatataaaatatatagatatatgtaatatatattttatatatagatatataatatatgtatcagagtttccttatgcactcattgattgatgggcatttgggttggttccacgattttgatattgtgaactgtgctgctataaacgtgtgtgaaagtatcttttttgaataatgacttattttcctctggtagatacccaatagtgggattgctggatcaaatggtagctctacttttagttctttaagaaatttccacagtgttttccatagtggctgtactaatttacattcccaccagcagtgtaggagcattccctcatcaccacatccacgccaacatctactgttttttgattttttggttatggccattcttgcaggagtaaggtggtgtcacattgtggttttggtttgcatttccctgatcactagtgatgttgagcattttttcgtatgtttgttggccatttgtgtatcttcttttgagaactgtctattcatgtccttagcccactttttgatggcattgtttgtttatttcttactgatttgtttgagttcgctgtagattctggatattagtcctctgtcagatgtatagattgtgaaggttttctcctactctgtgcattgtctgtttctctgctgactgttccttttgccatgcaaaagctctttaggttaattaagtcccagctatttatctttgtttttattgcatttgcttttgggttctttgtcatgaaatccttgcctaagccagtgtccagaagggtttttccaatattatcttctagaattttcatagtttcaggtcttaggtttaagtcctaaatttttgtttttatgaagtgcatgtgtatttgaagtgttcaaacacttaacagtatctcacttcacttagcagtatctcaatcatatctttgggttatcaaatatttttctaaaatatgattttaacatatgtggatatgtcataattccacagctgatatatatttaagctttaatttttgtcattatgagttgaattgtgtgaacaaattcatacatctttgggcatgtctctgatttttttccttaagacagattcttaggaggggaatttttgtgtcaaagactatgatcatttttaagattactgtctagaaaatgtgtccccaaatctactccacctggaagtatggccaaccttcctctatgtggagtattcaattattttttaaatattgtatttgcctttattgtgaatgaaatattatattttattgttttaacttgcattccatgctagtaaagcaagtgtaactctcaatgtccaatcacagatgtaaagaacaatcttgtttctctctttctggacaattccaagcccctatcccttccttggaccttttctgtggtcttttttctgggatcttttatggagactttctaggctcagtgaccactggccctggctactgctgagaccctgtggctctggtctgcagaccagaaactataaaaatgggcccttcaggtttgcagtctttgatgttcccattccctccttggccataaggccctcccacccctaactgcagcacccaccgcctggagtcacaggtgcagccccagcccctggcagccctcccgggctctgcaaggccccagccccatctgaatctcagatgttctccctggccaccccaggacaccagtatcctccattcagggcactgggcttttaagggagggcctgcctctgggctcttctcacttccagagagggcaaaacgaaaacaacatacattcagcaactcagaaatcaccttgctgcacagccagtctcctgggttcacaggtttttcctcctgtgtgtctccctgttctcctgctctttcgtgattgataagagctctttgtacaggaaggacagtggtcctccagttgtagtgtgtgtggcagcggttccccgagggaggcgttatttgctcttgaactttgcctgcgagctgtgcctgtgcattgctttgctttttaattttaaagcgagttgaagcctcctgtgtttgtttgctttcactgtgctttcctgattggaaagtcttttccacccccccattcagcatcttatggtttctttgctaacactggaactcaattgctctggaaggcacttgggggttaggggtgggggatcccattttctcactaggtagggtgtgcccccggcacccctaggaaagtccctccagccctctgcatttgctggattgcacaggaggcccagggtctcctgagggggaggagatgaggaggatgcggagaggtaccaaggggtcccccaccttgcaccctgcgaagtccccctttctccctgtggaagggaagataagcctcacctaggcgctgaccatgggtgaccccttactctgcaggtgggtgagacccttggagaggcctcctgctagtgctcagcagggttcccagacaaaaggaattgtcaccctttgggtggtggctccatggcactgcaggaccctggagagcccctcggctccggcccaggggcagagagctccatccagcctctgtttcccacctgggccttcacctcaactgtgctcgaggcaggcagggtgggggttgggtgggaaggaggcagagagagactctggagctgggtgcctgtgaagagggaggccatccttctgaagatgtcatcggggtctgaaggcacattggaaggtgcactcagtcaccgaaattagacgagggacaattgcgcagacaaggagccttcacccctgttagtcggggacacagctcggcccacgccccacctccacatctcctccccatcctgctgtggcagagcctgccctccagccctctgcagccccgaccccagtccggccctcagctcccagccccgcagctgcagaggcttcctggggaggggcagctcctggtccaccccatagcagaggtcaggcagctatcttgcgtctggcatctgcataggactaagagatccatcaagtccaattaggggaacagctccttcctgctctgcttagctgactaattcaatagcagccacccaggcctgggccggcagaggctctcccaaatccaatgaaggccttgctctgcagcccggctgccagcatcacccaggcattttgctcactcagcacagacccaagtcaggccccagccatacccaccaccaggagctcccagagccgtgctgctggcaccaggcctcccccagcaagctcccttcctcagggcttctgccctagagggaaggaaacttgtggccattgaggggtaggggaagtgccacagcccgtccaggcctgtcatcccaaaggaaggcccacagctgctttccaggtcttgtagaagctcgttccttccccggggtgctcttgctctgaacaatgccccagggcaggtggaggggcagatggaaatcagccacggggcttttgcaggcaagagtgcaggagggactctgcatgcctgggctcaggcctcagcagagcctgttgagggaagggatggaaaagagtagctatatggcctccctcatggggtcccagcccacagctgtgtcccaaacatcctgtgtgtccctcaacacccagcctggatgggttccttaactgagctcaagtcttagacccgtagaggcctggcacctccaggttcactcaaagggattacagagaccaagcccaaacctacccatccaatgctgggatgtgaggccctgccaaggggcttaagtccagctgcgacaggaggctcagagacatgagccaattatgacttattaaggacaaggcgttgtaattttttttaactgcttgatacacgtgatcaaggcttacttcagcctctatctcctgggctcaagtgatcctcccacatcagtctccccagtagctgggaccacaggcgtgcaccaccacgcctggctaatttttttattttttgtagagacagggtctcactatgttgctgaagctagtctcgaactcctggcctcaaacaatccttctgtctcagcctcacaaggtgctgggattatagacatgagacaccaggcctggccaatacccattttatagatcatttgagtgagggtgttttccctgtaactcactcagtcccactgaatttccgaggcacattctggaaagaaggcatggcatcactggtaggggtctgccccagtgcactaggacaccactgggccacggtctctctgctcttagctcactcactccatcactctcgaaatgatgtaatatgtacagacatctcaggataaataggtccatacctttggcaccttctgttaaagcagtaagttgtgttgtttatttatttttgctttgcctgcgagttgttttattgctgttgttgattaggtttttattaaaagtaatacctgcacaccatacatctcgaacagtattaaattatatgaaatgtgcacaatgaaatgtaaaagcctactcccaatatttcctctctcccagataactgctcttgaccgtttcttgtgcatactctcagaaaaacacttatgcaaattcagcatgtgcgcaaacagcgtgatgctgcccatgcttctgaggcatgctgtgtctgtgacgcctttttttaggtgtaatggaatggatgcccacgtgtggatgtgtgtgtgggccatggctgaccagtgccctgctgttggcccctgcagacaacgctccaggaaattttacttgttcaaattttacttggaaaattctgcaagtgtgttcttaggataaatttctggtagtacaacccaaaacaatgagctaaaaacaacctgggccaaaacatctgtgcaaggaaatttttaaacggatcttgtcaaattgttttcaaaaagatttccacatctttcaacagggtatgatgttatcaccactttccaatgaaaaaagaatgtcattctattttgtgtttatttagttatgagtgaagtcaagtactcttttttacatttttgtccatttctccattagggtaccttttcttattggtgcctgagagcacttagtccgtttaggaaatagggcccttagctgtcatatgtgctgcaaatatttccccccaatttatttgtttgtttattttatcataccaaagtcttacagtgtgtaaacaaacgtattgatcattttaaaattcatttggtttgggttgctcagaaaggtctttatttttttaaaaaatcatgtttacttccagtaattttatggcttaatactttagtctggaattgatttggcatcaaataactttatcaaaagtagccttattttttccttgtggggggtctcgagtcacgtcattatttatcgaatggtccctcattgttcccattagtctaaggccaccccattgcctgtgaaatttccattgtgacatctatatttggactctgccttgtaaatttcttatgcaatatcaaaccgtcttaactgtggttgtataacacagtccatttcactatcgctgtgccagccttttaacgtcctcctgtagcagttctgagttgtcttcatgtagattccacacacttgttaagattacttctatatatttttattttatgtattgcttttgtgaatgtaatcttttattccattacctctttatttagtcatggtttatgcatgggaaagccctcgatctttgcatgttatttttgttagtagcaactctgcagaatgctcttattttcagccaagtctttgggtttcattggccagccctgtacctgtgtgtgactccatcttcccttcctctcttctcctgtgtccctgtctccaagacatcagcagctcacgatcagactcctgccatgctccctggctgtgggggctgcagcctttgggctgatgtccgcttgtacgcacctccctcttctctgtctcatcagggttaatggctactgaactgccaaacacctttgcaacgtttgttaaactttacgttttttattcttcaggggttaattttagtcatttacatagctctagaaaatcatcatttttacctaagtatccaaattttctgtccagcagtttgcaaagcaggccctgatgcatcttttccatttctttgcctctgtggttctttctccttactcatttctgcttttctctcactccccactgccactccgcttttcttactccatggtaggagtgcccatctctttgttggaaggcaacagtcactctcctgtctggctctgtcccccaggagggctgctgggggtctgtgcctgtctggtgttgtcagactccagcgcggtgccattcaggcttgggagcccagtggtttctctgctgatgaaggggcccgtggccgtggtgggtgctggctcattcttcatccccaggagcagggatgctagaatggcctcagtttggggaaggagctgggggtactcctggcaggggatgtgctgaggaacatcttaccgtccacttggatcctgggggacaagagttgggtggcagttggagacccctgggcccatgagggtggggatgaccagcatactctggcaggcagtgtgtgggtcctctgaagcagctcccccaaaaacctagtggcatatgcccctgttacagccctgaggataaggtggggaggctggctggggacatggaagttggtgctgactaacgagaggccagtccctggccctgtggcctgaactctaggtgtctgtggggttctgttggcacagacacaccacacgtctatgttcatggagactttgtcactggcaaaggcaggggcttctcagcagggagggggtagagccaggcagggcagcagtgggagggctaaggtccccctgggtccctggggaaggggctggaggcagcagcagggagactgggctgttcagagggacctggaaagatattgggtccagcagagcgactttggagtccacaagtgatgtggagttggggaggccctcaccccaccccaggcctggacccctgagctgtccaaagcagctcctggtaggctgcggctgaaatggagggcctgaggtgagagagaggagcagaggggctcaagcttggggccagtccactggggctccacgaatgacctgggagaggctcagagctcgtgaaggggccagggtgtcaggattgttcacccagaggcacccctgttctcatccaggttacagaagagcctcaggtccagtgggagaggggagaatgccctgcacacagtgccagcccctccttgctgagctctgcatgcctgggtgaggggctgatgctgcacccccgctggggctgcctgccagggctctggaccctcccacaggaggccaggcctgtgcccagtggcaggggagggtgtcctctccagccagggctccagcctccctccaggctgctctagctggccccaggcaatttgaaaagccccctgggatttcctgacagtacaggcccagagctgaactgagcacagccctcagccaccaaatgggccatcagtcacccaaccctgagagcccaccccctccagcctcccctgcaggcagcatcaccctgggagccctgcactccagagccacttcctccctgaggccctgcacctctgacagccaccacaccatgcctgagccgactcagcctggatgaggtgcagtcttctccaggcctcccaggccccacgctgcagccacacaacctaccgctccatcacagttaccctaggagggggttggaaacaccagggctggcatgtgacagactggctagcccctaggtccttttgaggtccagagaagagactacagggtcaggagcaggagagactcacgcctagggtgagggggtgctctgcatcattttcctggtgcagaaacaggttggagcattgctgaggaccctgagcaggatttgagccagggtgcacccgcagggcaggacggaagatgccacatggctcacccacccctggggccacatgcagagttactgtcaagccacgtcagcacccgcagggcccagtgtgagcacagcagcgactccaagtgggtgggagctggcaagccacctgctggccagggatgcctgttcgcctgttagaggtagcgattctcgttcagagtggaccacagcctgatgacccctgctttcaagaaggaccatcccatcttaaacaacagctccatgaatacaaccctccctgggagtgcagtgaggccatttttaccaggctgcctgtaaggatggggtggaggattggatctatggattaacattccctttggggacgcatcgcgggcagatgagaaattcccgacagcttgatggtcagggtctccattacccatatatcaaggagaggaagacggattccccacgccgactgcctgcccagcctccctgccgacagccaccgctgaagggcggttgatggaggttgtgactgtccctgtgaccaccctcctgaggccctaaagcacaggagaactccaggcagaaacagatgcggggtaatgtagcccccctcagccccagctcctctgggaggggctgttttgtaaatcactgccagccccgctcctcctggcaggtaagattgaggcagcagggatgtgccccgagaaacagagctggtggagaggtttgagggggcatgtgggtgactgcctgtccccaccaaggggcaggggctgcctttctatctgggtcggcagacagccaggctgcccccagggaaggcaggggtggcgcctggggtggatgctggcattggaatgcccaggtaaaaccctgactccatccatgttatttatcctctctgagtcttcactctgtcgtccatgagacaggggtgattgtatgtgaggaggaaacccatgtgcctgagaacagcgtggtgaggagcttgcacatgtggcacagagacggtgcgcttgtgattaggtggcctgagggaaggagtactgtggctgtgggtgttgggctctgctcctcagaagaccccagagggcaggtggctgagcagatctccagagctggagtgcccaagtggattctggggtcaggaaaggaagtgatatgattgggggccacagtgggacacttgagccatgtgtccaaagagcctctgcactcacagagccctttatcttgtggggcagaacactcccccaccatgaggactcttctgcacatttcagagggcaggactgcaaaacccaggttccacctccctctcccattttctggtacagcatatggtaggtgctcattcatgctgagtgaatagagagctgggcaaatgctcactggcactgagcttcactgaacttctcacatgctactgtgtattgaatcttgtacatcttgcagagcttcgtggttgaccaagcacttgtcatccttcactctccttgcttgtcccgtatagctgaggaatgctgggcacaggcaggcaggattgctgtcgccgttgtacagagcacaggctgcccaactgcaagggccgtagagagcatccaggtgccatgagcaccagaggggagtacctggcctcatggtcagagaccaggtctagtagaggaagggagacagggatgctctcattctcagagcagaatcctttcttcacttaacctattttgttagcattaaaaaaagagaaataggcttgggccttatttatgctcctggtttttttaaattgttttattaatatctactctttagtacttctttacctgctttttgcttttcaatttaaatacacttaagtctttcttgttgtttaattaatgtatacattgaaaggtgatatgttttcctgtaaatactgctttagctacattccacaggttttgctgtaatttcctatcctacaatgctgaatgatttgaaatttccatcttgatttcagtcatttaggaggatatttgtaaatttccaagcatatttttatatacgtatttcttaattgcttattttcaatttattacacagtcagagagtgtgtactatatgatatcattttttaaaatttcgtgggacttcctttccttttacttcctgattttcctaattttttaatctcattgaaccatccattactttttttttttttttttttttttctgagatggcatttcgctctggtcgcccaggctggagtgcaatgggtgcgatcttggctcactgcaacctctgtctcctgggttcaagcaattctcctgcctcagcctcccgagtagctgggattacaggcgtgtgccaccactcccagctaattttgtatttttagtagagacggggtttcaccatgtggtcaggctggtctcgacttcaagtgatcaacctgcctcagcctcccaaagtgctgggattacaggcgtgagctactacgcccagccctgagctatccatttctgataagaaaatgttttaaagcttacactgaggtggcaaatttgtcagtttctctttgcagcaagattatgttattaagtgcgcacaagttcatggttagtgagtcctactggtaaatgcattgtagtgtccctcttcatcctcatgagtgcttcctgccttcattctgtgtccgttgttagtaatcccatgtcagcttttctaatgttttggtctcgtattttctgggtatgtcttttatccctttgccttttgctataatttggtttaggtgcttctgtaatgtcaatttcattcatgaggaatcaaattctgctctgttacagggaccctagctgatccccaacccttaggaacagagagcctagaagtatctatgctcatgtccatgtaatatacacacgtgcccacacacacctcacacagttcttacactcacacatatacacactcacatatacacttacacgctcacacatgtacacatgacatacattcatactcacacatacacacccacaaacacatatatactcacacatatacacttataccacaacccacaaaaacacatatacacatgacatgcactcacacacatacatatttatgcacacaacatacattcatacacttgcacactcatgtacacatacacacttatacactcatgcatatacacatacaatatacacacatatgaacacatatacgcatgacatacatcacacacatgcacacttatacatacaacatacattcacacatatacactcacaaatacacacttatacacacaacacactcaactacatatacactcacatccatgtattcacacatactcaaagcaattttaatttgtaggaaatctcagtttaaaaatagctgcagttcctacctgggcatcaggtaacctggaagagaggaaggagaggactgtaattagcgaaattcatgattcgaaaagaagccttggcaaggactggattcgagtccttttgtgaccctggctgggcgagactcatctcttgggagcctttgttttcctccctaaatggggatcacctgagggcacctcctgctgtgaagctaccagacaccctgaggggaagggatccctgggctcctgtcaggaggatgtgaactgcctgggtgggggcagcattccccctacttctcccctcctgggtaagaggctgggtctctggggcaagtggagtcctggcttatcagtcagccacaccatgaacacccagttctgcctccaggtgtcaaataggcaatttaattaaacagaaattcagcagccagcaacatgacgtcatagttcctggaaacagaactgtagccacaattctagtagctcattctgtccttcaagagtttaaaattttttaatgccggagctccatttgatcaccttcacgcggccctggtgggtcaggcccacctgctcgctggcagcccctccttgcctctctgtggtcccaccagtaattaagccttttaagagctgggggagcttcaatatcggtaattcaatctccccctgtttactgatctctgccattagccgagttgaaagcaaaatgttttaattaaaaagattggcaataagttggtgtaatgccataatttgcacagggccccttctagaggatgacttcgccctgcctcagttgctatgacaactaatggacaagattgttccagtgtgagaagcagcatgaggaggggacaggagtgggaagaggggcctctgcaggaggacagagctgtgaggtggaaagaccaggcctctccgtgagctccagggaggtcttgcctctttgttgccatccctgtggctggaagagtcgtgtctctaagtgcctgggccaaggttgtcatggccagtgccatctgggctcaatggtccagtacagagcagagggcgagactcagcagccattcaccctggagtgtactggggccccgcctctgaacagggcagctgtgcggcgggccaaggcagaccccgggtaaatgtcaaataaatgcccctcacctcccctcccacacaggggccaggtaaagggacgtccgcatgtcacctgcctttgtgtgctgactgtctgttgggacacccaggggccaaggtgatgtcctggagaggagctggctcgggaggcactcaggctgcagtctccttccaggactcccaggctagacagagcagaagatggcaactgctctgggtgccccacagctgatattcactcacttctctgaccatggggccagatcctcctgaagaggtaagccctttgtgggagcggataaggcgaggccttgtggaaagggaccaggacattccgagtcttgatttcctcatctgtgaaacgggaatgaaagcatccttctctcagagtcactctgaggactgacagaaaccgcatggtgggtccaacatcctctgcggctatgctagtggtgtgggtgtgccttgaggagccatggggggcaggggccctcgccagtcagctgctgtctgcacccagggccacagggcaagggtgggctctgaaagagcaggacaaacagccagaggacttggctccccgctcctggaggagggcaggtctgaccagccaggagcaggttggggtgtggggtgaagcagaaaaccaaactcgagtgaaatagaaaacatggaacagttgtgcgtcctcacactacagcactagtacatcttcacactacagcacttgtgggctgcggggccctgcaactgccagtgctggggcccggtcttctgagccacagcaccacgtgcagcagggacgtgatggctcaccccgctctcccctccaccatgagcgcacccacctttcctcaccctgccagggcaggacacacctttgggggcgccccaggacatccaggttttgaccccacaatgctcaggaaggatgacttgtgagtggaggctgggccattctggggggtatgctgaggcgtgagcccaaaggtgacaagtgacacatgagagcaagtggcaccaggtgccattcactcagctctgcttgggaagcccccctggggtggtagacagtgtcatgctctggtattctgtgctgtgaccagggccacctcattcccatacaggcccccagatcagtatctccaccaaccatactcaccatgggtgcaggaacatcagctcctctcctcctgagagtcactgggcagcgtgggggcaggcgagctggaggaggcgcagcttctggagctgggaggccgggtgctcctgcccgggagcccaagggcccgtctgacctcagagagcctccttatcagccgcggggagggcgatctatcacgtggcccatgctggtgtggaaggacaataaagcagatattgaccgtgattctaatcgggtgagctgggcctctcagccccacagaacacagcatgccgacttatgggttcagacgcgagaggagccaagcctgagcaggaacgagataagaacatgccctgggtgattcaatttaatgcaaccgtcgctcccagcaaccttgatttgctaagtgctggggagcccagagacgaaggagacagggggccagcatgttctggtctgacagcaggcacagggcctcgccctggtggggtcagaaggctaaggggatgtatgtccttgaatccactgggcagggaagggcaggggggtatgtgcagctgcctggaggaaaccccaggccccactgagccatggggagcaaggccctgaccagcacttgctgcagatggcccctgcctggagccttcccacctgctcctctgcagatgcctcccctctccctcaccaggaaagtcagggtatcccgactctgtcccgtgccaattatgtgctgtcatccagcccctgcatggccagtgccaccatgggccggtgaccgcgacaccctccacccacgagccaaccacacactctaagcctgcttgaggcctgtggcacctggtaccctgggggccagaactgttccaagacccaaccctgatctcctccctgtttaaactggcttattcctgctacttgggtctaaaaccctttgagagctgggcatggtggcacatgcctgtaatcccagcactttggaagaccgaagtgggcggatcgcttgagcccaggaattggagactactctggagaacatggcaagatgtcatctctatcaaaaaaaaaaaaaaactaaaaaatgagccaggtatggtggctcatgcctgtaatcccagctattcaggaggctgaggtgggagggtcactcgagctcaggagtttgaggccagcctaggcaacaaagtgagacctcatctccataaaaactaaaaaatttagacaggcatagtggcgtgcactggtagtcctagctatttgggagactggggcaggaagattgcatgagcccaggaggtcaaggctgcagtgagccaaggtcgtgccacttgactccagcctgggcaacagagcaagaccttgtctctaaataaataaataaataaaacccttcgagacccccacaccatcattccctcatcccccacctaacccaaggatgccctattgcccatcttcagaatgcaggcaaccctcacctgcattccttcctcaactgcatgcacccccacctgacccttcctcacctggacacattctcacccagctctctccctggcaccatcccctcagctgtcatcctccacagctctctggagacaacttcccccgtgtctcctagccctgccctgccccttcccgcagcagcagaagtttctggagtgtgcactgggtcccgctgcttgccagcttggtcttgctgccatccaccatggcagccaggccaaacccaccctcctccctcctctaaacacccctggccggcacctgcttaccctacagtctcatctcctctctcacctgtcacatgctccccacatgcagctcttgccgcctcaccaggttccttacattcaccctatctccgggcctctgcacgcactgtgccttctgtttagaagcatttatcctgcattccttttggtcaccttccttcctccatgcagaccttgtccctggggccctccctctggcccagctgcagcaactcctgcctagagttcctctctgtaacgcacttaccctgagtcaattctcgtgcttgtgtacgtgccccttgccccacaccagctgctccattcggtctcatccaccgttacacatgccacacccacagcagggcctctgaggcacccagtgccacagccacaccagctggatggctctctgtgcctcagcctgctcatctgtaagatgggggatcattgtgcccactcccagggctcagtgagggatgcacccaggtctttaggacatgctgggtgtgatggttcttcactcccttcgtggagagctgtgtaacctgcttgggatgatgccatcaggaagggcagatggcacagggtcataaggccacggacacccagctctgcttggagcaaaatctctccagggcactgagacagaggccccccaaatagcccgcctgccatcttccctcacgcatggtccctgtgctctgcctggcccacgccttttttggctggggctcaggctctctgtggagtgggggctgggggagcaacagaagaggccttgttgagggtcccaagggtccccacttacatgccacacggaccccagtgcagacccatctcccaagagccaggtccctgattggatttagctctggcctcccagcacctcacgcccatatcccctggcctgtctctttagaggataatcagaggaagtaattctatttgagaaacaatcactcctgtggtatgatggtgcactcgatgttaatggacccagcatccttgcatactaaggacgcatttcagccaagcacagggtgtttttcgagaaaggtcttgttccccatcaaggctctgccctcactgagctattagcagccaggctgaggacatgagcttgaggggaggtgcagactcagaggtgctctgtgcactgggctcctttgggcactggcagacagggcagaagttctgcctggggaactcgggctctggcaggtgttctgtacacccacctggcataacatcagcctgccctggtgccatttccattatcagtccatcttacaggtgaagacactgagaataagagaaaaaaggaggatgtccgtatccacacagctggtgagggggagctggaaaccctccagaacattgctcccgtgctcccccacttctgctcaccctctgctgactcagtttcccactttctgcctgctcgtggtgctgcacccgctgccaacataactgtaaatgcaaaaatgatgatgccacaccttcccacaaaattcttcaccatgtttccaaggcctacagaagacgctggagctctgggatgccagtgcatgggcacgcgccaccaagacaagccccctctaccttggacccatctcctggccaatcatacctggcaggcggccctggcccagccatactgcaccccctgcagggtcctgttctggcctggggacttcacacttagccttggcaagtgccacccccatgagggaaaggctccccccacccctcgtgtcctatctaggtgacagccactcgcccattcaggaggattctgcctgagcacctcttccccgtcaatgtcactccccgagcctgggcctgccacagaacctgccacgtccacgcaaggtcctgctcctgggtctgctcctcatctgagcggaggggagaggcttctccaacgctggagagagtgcagcctccggcagcctgtggggccacagggcctggcctgcccagctttctccttcattcattcagcacatacccattgaggtcccactgcctgtcaggccctgctgtgggctgccataacaagataggttacaccggcttgagcaaacagtcatttctaacagttctggaggccggcctctggactgggttccagcagggtcagtggtggtgaggcctctcttcctggtttgcggccggctgtcctctcatgacatcttcccatggtggagtgagatcatgccccttgcatccctccttataggtgcactaatcccattcatggagtctccacgcccatgacctaattccctcccacagccctcacacccactgccatcacgctggggtttgggctttcacatatgaatgggggtcacagataatcagcctagagtgggcactgggacacagcagtgacaaaaagacaaaacctatgtccccgagggcccacatacccactgaggacagaacttgccgaggtgatgctgagccatgtggacacctgggggagatcatgccaggcatgggggacgccagtatcgaggccctggctaggggtccctggtggatcagtgaggtgcccaagagagcagcacatggctggagcagtggcacagtgggttctgacttacatctcaggagaatcctgttgtctcgggcagagaacaggaggacaggctgcagtgctggtggacaggaaagtgcagaatgggccactgcagagatgcagcaggtgggcaggaggtgaggggtcagattctgggaccacgggaactgctggtgcgtggggtgaaggaaatgagagaagccagcacccagggagacgccaggacctgtggcctgagaaactgggagtgcagggctatcatcagctggagtggggcgagggcaggcctatggggaaggaaatggggacaagtgccttttgaatacctactggatgtccaggtggacttgtttgtaactggacattgtgagcctgacctgaggttcctgccctgagcccccatccccggcccccttgcagggtcagtgaggcacgagcacaggggtcagtcctagggacccaggcctggccctcaggggtaactggtgcccatgttgccctcaagggctgtcccctggtcttggagaacattccctgagagctgtcccctggccaaggggaagtgagggacacactagtgcctctcatgataccttggctggagcaggggcttggaggggcagcctggggccctcaggttcctgctccccaccccatgcatctcagcccttcactcccagggaagctgctgcatgccttccctagaatctgtcccacagggggtgaactccctgcctgtcaccactgttgaaggatgacttttcttctctccacaagccagggaattaattcatgccatctattttactgagtcggatcaaaggttgtcaaattccttcacccacttaatgatctgtaatatacccttccatttcctgaccaggctattagataaaatagaattcataatggcctcctggcagcatctgtgcacctgtgtacatgtgcagggtcagtcaagagaccctaggatctgctcagccaggatgtatctttttttccaagagattctgcaaatctcaatccatatggggcttttagtgccaaacatactctatggtctgtgtgaggctgaaaatatatgactcacgagtcaccactgcccttgccctgtccgtggtagacattattaatcaattacaggcactcttcaccactgagctcagatgtagctccttccacagccatcacacatgatacatgtcctggccggggcaaggaaacctcctgaccatccagatgagagacattaattgatgctgctcaccacactgttgtttctccttttttttatgtgtacggtggcctctgagcaggggtaatatgaggtgaccaggatccccccgctgagcctcctgcaggctgcttcagtgggcacagcccatgatcctactccacagtcaggaatgagcaccccaaacctgccaagctcccacctcacaggaggtctattgtgtcagcctcctgagctcctaggcatgaaagcaccttgctggacaaaggcagggattgctagcaggcagcagcacacaggcgatcatgggaagacccggggccctgcccgatccaccacacacccacacaccagtcatgctccatcctgtcacaatatcaaagaggaagcatcaaggctgacagccacagctgaaaagagctgtgcacaaccgccaccttggtccctgtgaggggtctggtcactggcctgacggtgacaccttctcggggtacagagtcccagactccctgttgttcctgtcttgggagcagtattggcgctggcctcaggccacctgggcctctccactcccttctcccctagcaggcctcttgctcagagctcctacgaggtctcctctcccagctcctctgagctgggctgcaggctgggtgtgtagagaagagcagaggaggctgggagagctccctgaagtcacgttactgtctgctcagctcagagagaagagcttcagagacagggaggactgagttcaaagggaagccctggggctggaggtgaccctacctggctgccgcagaggactagccacatgcctgccacatgccaaccatcgtcccctgtcactgcagcctctgtcatgtcagccttcagctccctggagcagtgaggcgggctgtcctcgcccctgcctcgacctgagccttttaagcaaatcagcaatgtaattattgatctgtaaaagaaaaggaattaatatggccgcccacatcctttgtacataagagtatttaacaatgaactctgcttaaacttcataaaagcctcttcagcaaatcagcacagaagtatcgatctggaagctggcctgtgaattccagctgactgcctctcccactgaaggaccattacttggtcttaccgaatctcctctctccatttatggctgggcgcttcctcctgggacgcttctgctgcctctccacagggactgagctgcccagttttgctgatcctcccttttcctggagtccagcgtatcgactggagagagtactggggaggtgctcttggttggggctctgcagccaccctgggcctaacaccccaggctcaggcctgccctagagacccttggtcaccctgcttttcatggagcagaagctggggtactcggtgtgcaccctcttgttcaccctcccaaatgggcattcttgcttcaccttgcagggtcacccagatgctgggggctggggccagccttccagccaatggctgagcgctttccttctcagatatgtgagttggggctggcatcacccacaatgtagcaagctggacccactgccactgaggccgtgggctctccctaatgggatcttgtccaggtacccgaggaggccagtgagtcagcaggctctgccagagcacccaccagccctggcatccagcaagatggctttgcccttggagccttcccatccaccctgggcccagcctgccagttactctgagcctgtggctgtgcatctggcctgggaccctgtcctgtctgctgggtagtgtcagggtcccatgggagagtcagtcctatcttgaagcaggactctgagctcactgccagctgctcagggttctcctcggctgcccagctctaggagcagaggcctgaaccctgtgacctctgtggggccacttgcagatggggcagggatgggctggtggatgagatggggtggctctgcagatggggtgggggatgccgacaactgaggcagtgagtgcagtggcaggagttggggtctctgggttgggcctcgtccagggctagcatctagggggtccagaacccccttcctctctggccaccatggctgcctttgtgaaatgagctctggccttggcctctaaggcccctacagccctgactttatgcatagcagcagaacagggtcagagagtccaaaccacagaccccacgtcacaggccagcccctcagaaatgcacagtgcctaacaggaacagagcctccaacacactgggaagtggctgtggtggcgtccgcccccgctgatcatgtcgtctgccctgcaccctcccacgcctctgcactggatgcaagctcactccacatgcctctctctgccgtggctcctgccttgtacctcctcctctctgtctcattcttcttgtctttgcctccttctctgtcagtttctttgtttctattttcttctctgctggcccctgttttccctttctctttgtctctttctgatctttctctgttaatcctgacgttctggttgtctttctggccacccccacgaccactcatgtccagcattccctggatcagggtgggtgaggctcatgcccaggtctcaagaggaggtccgggtgctgggccctgcctggcaacttggagaaggctccccttgagaacactcactcctccagggggatggaggctgtgggggcaagctcttctcagagcaggtgcacagcagtccctcctggccctgcaggtcttgctggttgccctaccatgagccacatcttggggccggcagtggggaggaggagacctctgtgctggccatgatttgagggacaccagaggactccaagggtgccccacctcacagcatcccttccccaccttcctccaacctgctcctggctgccaatggccaggacaggtcaggtcaggtgaggggtgatggggaccaccagagggctgcaggctgccaccccctccatccagctgccgaccagctgggagaggtgctgtcctcacactcacacaaagccttggtgagagaacagagagggatgcttgcatgtggcattgcacccctgggaagaggagcaccccaggaacttggggtccatgcggtccatgcctcggggccctatagcctggagtctaggtccccaagctcctccaggccaccttgagggcctctgccaacacgcactgcctcaggagggcatgcaggccacagacaaggggcagggcctcagctctcactagaaagaagccgaggagggggcctctgaggaactggcgggggtcccacaggcaggacagcccaaggtcatggcctctaactcagagggggcctctggaagcgccacgttcactaggcacgggctggaggcagcccgttcactagggcggtctcccgaagacgtatctgttgcaggggcagcgagaattccaggggaactctagaaaatgagtggcacctgccctccttgtgactggtcaaggaatattggggcctactgagcatgcttggggtaccctcctctgcagatagcccatgcaggtccaggggcctgatcccacctgccacccccaggctgggagactcagagcccatcagtgctggtgtcagaagaggtcgcccctttcctgacccctctgcttcctgccacccggagatcaaaaggtgtctcctcggcggttcctgtcaccagccttaatgcacgctctccccattagcacaggggctgggaggggaggcagccaggggaagatgggagcctcagatctgagcccagaggaaggagacaggggtgggaggtctagggaagattcagcgataggcctgccctcctgcggccctccagacaccagtcttagagccctcctgcatggggagacatggggcatactggggaagggtgaggtcctctctgagccccaccagccctgacttgactgccgctctgtgctgagtgctccccgcacacggctcctggtgacagcacccgtgtgctagtaccgagccacagggtggtcacagatgctgtccgtgtggtctccagcccgtgtcagtggggaagggcccacagtgcttttctgaggccagagcactgtcattgcccctcgaagaaccagctaatggcagtttccagactagaacctggtctcctcgtggcctgtgcagggttggggtgctcagcccagcctcagggggtcacctacaccccacccccaactgcccgtaggcccagggagctggagagcttccctgcctgcttgcaggcactcacggccctgtgacacacacacactcatccccaatgaaggtgcacccctgaccaggtgtggaccccaggccaggcagcaaagagacagctggcctgacttgggtcctcagcctggcccagccccagccgccggcttgagcaagcccttcccgagaggtcaacctcccatccagggcgtgagggttgcagcctgatcccaccctgctgcatctgccctgtggagccctcgtcctttttccctggggtctccctccccgccaggccaggctctaccctcagggccggaggcctcctgggggaggttcatgtctcactttgcagcctccagccagatggcctccataattcattttagtgaaatatggcaacacttttattggcgatgatcctatctggagcctggggacagtgatggccagaccagggctggtatctgctttcacagagctccgagaaaagcctgcatggttatgttcgcggatgtgcactcatttcgcgttgctgggagggggggtggggcagggcagaggctgcctctgggtctcctgattccaggcagtctggggcaggaggcccacaggcccctgcactggcctgacagaaggctcgggcccggggcagaggggtgggctgcaccctgcactgatgctcagaccaagctgagaggtggagaagtcaggggatatgcaaggtgatggggagcagctacccagagctgtggggtggaggccatgggtgccactcagcccttggaggagctgcctcccaccacctgcagcaccagagtggccctgctgagctgcaggctttctccctgcatctccagctcacactgttgtgtgctctgtgccccagggccagccccataggattcagaggccaacctcacttcctctgcactagcagcccagagacccctgcctgatagatgaaccccaaaactgcagtctcagtaggaccttagttgcagtcacaagtccaagaggaagaaggagaccccattcctggtcatgctgtctgccaggctccagcccgtcaccccttaccgtagccagcccagacctggtgcatggtggagcatctacaagcagaaggtgaggcgtccccaccatgggtctgctctgcagccctgcggatgtctcaccagcctgtatggggtgtgctcctggggacaccaccttggggctcctccagggagctgaaagagggcaggcctgggggacacgagatggacagggacctgagaactgcccatggcaccacccaataagcctgcacctatcccttcatccaaacaggtccaggaaaaaggcaattacatccccaagaaatgtggccagtcagggagcgtgagagcttgtgctgctcttgggggccacagagacccacctggctggttctggatgagacaaaggctgcagactgacacacctatgcaactctcctcctgcccaggtgagatcagtcccaagtgtcagcatgtcagccacccccaggagggtcctgggcatgttatctgacctcgctcaggcagaggtgaggctcagcgggtgactggggcaacgagacccagactagcgggaggcaccagaagggatgcaggcctggacagggtgggggctgtgaggccccaagtgtgcccggccaggacacagctgtgctttacttcccagaacggatggccaaggtggtctcagacaaggctgtgcctctgagctacattcccacagagacttcagggtggcagtgcagcctcagcctgcgccagcacccccaggccttcccgaggtgcctatcgacctgctgaacccagctaatgggctcctctgggcattgagttcagaggcgaggttgcctgtaagcaagattcgccagtgtgcttcatcagcaggcagcctcatgcaatatgtaacaccacattaacctgcactctcagggtagacagagcccccgccccggaatccggaatccggaatctgctgctatgtagaagtggcctgggacgggaggcagagcctgcaggccctgtccttttccctgtacttccatctccccactctgtgtacatggggtgggcagcaaagctggcgcttacaccatggcaccctcccctccacctatggcaggccttggaagtcaccggcaacccctgcccctccaaactcagacacgtcctcaggatctctctcaacacagtactgcaggcaaccacaactgggcagcccaagtgggtgagcaagatcaatgcggaattgcaaggggcctcaagtagcaaaaacaaccttcaaaaagaagaacaaagtcagaggagttacactttctgatttcaaatttactacaaagctacagctgttaaaacagtgtaaaactggcatagggatagacatataaatcaatagaataaaattcagagtcgtttaaggccagttaatttttgtcatggatgccaagctcattcaatggggaaagaacagtcttttctacaaatgttactgggacaacttgatttctgcatgcaaaagatgaggttggacccctacctcacactataggcaaaaattaactcaaaatggatcaataccctaaatataagagcaaaagctgcaaaactcttagaagaaagcatagtggtagatcttcatgaccttggatatggcaatggattcttagatatgatatcaaaatctcaagtaagaataacaataacaacaaaaaacagataaattagacttcatcaaatttaaaacttttgtgcaccaaacaacattatcaagaaagtgaaaagacaaccacagaatgggagaaaacacctgcaaatcatatatctaataatagtttaatatccagaatatataaagaacttctaaaactcgaaaacaaaagaacaaaacaaccaaatttaaaaatgggcaggctgggcatgtagctcatgcttgtaatcccagcacattaggaggccaaggcaggcgggtccatttgagctcaggagtttgagaccagcctgggcaacatagtgatactccatctctacaaaaaatacaaaaattagccaggcatggtggcttatgcctgtaatcccagctactctggaggctaaggctggaggatgacttgaggctgggaatcagaggttgcagtgagatcatgccactgccctccagactaggagacagaatgagaccctgtctcaaaaaataaataaaaataaaaataaaataaaataaaaatgggcaaaggatttgaatagatgtttctctgaagaagatgcacaaatgccaataagcacatgaaaagatgctcaacatcactaatctttagagaaatgtaaattaaagccaccatcacttcacctattggcatggctataatcagaaaagctaaaagtaacaactgctggtgaggatgtggagaaactggaactcttgtgcattgatgatggaaatggaaagtggtataactgttgtgtaaaatagtgtggtcattcctcaaaaagctaaatgtatagttaccatggaattgtgacccaataattccattcctaggtatatactcaacagaattgaaaacaagaaatcaaaaaatgcttgtgtcccaaagtttatagcagcatcatccacaaaagccaaaagatggaaaccaggcaaaagtcaaccgacagatgaatggataaatacagcgtgctccaccacacggaatatgattcatccgcacaaaggaacaaagttctgacacacatgacaacagagatgaaccttgaaaacattatgctgagtagaataagccagacacaaaaggacaaatattgtaggattccagatctaaactaggcaaatttatagagacaaagcagattagaggttaccaagggctaggggtgggggatgggaggttattgcttaatgggttcagattatctgtttgggatggtgaaaaagtttgcagtgcacaagagttccagttttggaagtagatatcagtgatggttgcacaacatcgtgaatgtaattaatgtgaattatacacttaaaatggttaaaatggcatttttgtgatgtatatcttttgctacaaaaagaaccattttttaaagaagcaatggtgagcaaagttggtaaatctgtaggtagatccaataaagccttgacaattcaaagaaaagtaataattaatttatggccatacaaacagggtgaggctagtactccaaacagcaaagcctagcatgcccagtaccgggcaaagagcagggggagacacgggctgtgtctacacaaggagcatgcctttctagcacaggtattaaaactttaggacaatttattaaagaaatagaaaatatgatctctgtgttagtttcctgtgattgctataagaagttaccacaagtctggtagtttataacaacaaaaatgtattctcttgcaatcctggaggccaggagacagaaatcaaggtgtggaggaggcagagccatgctccctctgaggctcgggggaggagccttcctggcctcttccagcttcccacagctggcatcattcctgagctgggccatgtctctccaatgcctgctctctgtttacagggccttgtcccctgtgcaggtctgggtcaaaactccctctgcttctcttttataggatacatggtatttagggccctggatgacccaggacatgctcctcctctcaaggtccctcactcgatcacatcttttgcaatacaggtgatattcacaggttccagattagacatgggtgtatctgtgggagtcatgatcagcctaccataacttccaagcaattgggaagaagaaaaagaatacagaaaattgagtatttctaatagaagttaggaaaggagagagaaaatggaagtccagaagccaggacaaaaaaataagtggtggaaataaattttcctagatccagagaaaacagtaaccatgaatgtactgaacagagactgtcagattggacacaaaagcaaagtcttgtgtcagacgttgcttacagaggtcacagtgaagtatagaaaggtagaaggcaagagggtgtggaaagccgtggagtgtaaatacggatgggatgaaagttggtgtggccgggccaatccccaacttagacttaaagacacagagaatccctgggaatggagacagcgactcccagatgatgaagcagcagagagatcctccaagggtgagtgacctagagcactttaccagctttgtaaaggaaaaggcatttgcctggaggctgcagggcccagtccagcctagctccaggacagctccaacccatcctcccatgggtggggtgtccctggtccaggctagggacggtccagggtgggttggcaggacctgctgtgatcgtgaagttgggaactgcctaaaccatcttctcagagcctgtgtgtccagagggaaaacccaagcacgtggaatatggtttacaagccgtggttgctgaggacaaggttggtaatgaaggcgcagggaagcctgggagggcagaaatgcacaaggaggggtggggctggagcccggctggtcctggtatcctgggcttggggggaccctgctcctttccctgggagccctgaggcctcaactggatgacaggaggtggatatgctggtccctgaggcacaggcagtatgaacctctgcatggagctgggtctcagcagaagcccacccaagcctggagtttcccagccagggatgcacctttttcatcccagcagcctctgtccctcagtcctgagccctcaggggccctcagggcatgaaagcaggaatcccaaatccaccttccagaattacacgggctgttcttggtggtcaggtggcctctcggggccagggtcctttttaagactggaacctctccaagctcaccagcactctcagtgcacgcacgcacgcacacacacacacacacacacaccaggattttaaactcagtccaacaaatctcagcatgcaccagaactatttcagcattttaagagcctgtattgattttggaaggagccaggcagcgtgtgaaggccattctgtctgggatcctatgctgagtctggggtctctgtatgagggattatccatgtgtggggagccttcccccttcagagctttccagcttccctctgatcacatgtcctgagcacactatcccaaacctaaccccagctgggctctagcaagagacgaggtcctgtcttgctgggaaagggtcatccttcccacccggaggcccctgctctgccccagtttcctgccacaaagcccagacagtcctgggaacctgggctggtgagtccctccatcaccttcagaaacagccatgaggagctggcagtgggatggcctgggggtaggagcgtggcttctggagctagaccacatgggttcagatcccagcggtgcctctaactggccacaggaccttgggcagtcagctgaccctgcccagtcccagcatcctcatctggtcttagctaacagggacacacctgaggaggtggtcttcatgtcacttccactgggaccagttttcagagcagctgcaggggtcatcagttaaggcagtacagcccacttacagaggaggcgggtggcttggggtgtgaaggacgtgcccaggtgacatgctgctgagtggccccaaccccatccaggcaccaagccagagcctgtccccagggaccccagggcacatcagcagaagctggaggatgtgggtctcctgggcctggaatctcagagcccacattggttaatttcacacgtccgcttgactggcacacagggggcctggatgtttggccagacattatgctgggtgtgtgtcaggggggctctgggtgagatgaacacttgaatccatggactgcaaagcagacagcctcccagtgtgggtagacccatccaacctgtcgcagacctaagctgaacacaaaggccaagtaggagataattcattctgcctggctgccttaagctgggagcttggtcttttccaggcttcagacctgaaccgaagtacaggctcttcatgcatgtcaagcccctggccttcagactgggacaaactccatcagctctcctggggctccagctggccagcagcagatctggggacttctcagactccactatctcatgaagcaattccttgccatccatctcctttaataaacacacacgcatcctatcacttctgtttctcgggaaaaccttaactaatgcagagcccgagagtggggcatggctcagggctgctgcacccaggaagcatctgtgctccctgtgcttccaggcagggaccctcatggaggggtgggatggtcgtacttcctcagccagcacttaggggccgtgaggtccatagccatgagctgagggagtgaccccacagtttatgtcactgtggagaaaggctccctgagctgtggatccagccagtgggttgtaaacctgactaagacactcaagctgctgcggccgggggcatgccacaaacccccagtgagcctcagtttccccctgtagaacaggggtgtgagagcagtctcctcagggtgtaaagagcccagcaaatgccgggcacagctcataccagataagcattagctggtggcagaaaagctggaagacagactgctgacctccacaaaaggatcagatttgtgccagtcctggccatggacaacaggtcccaggcttgacctgtaggtgaagagcccagagcccaggaccacatgccaagtgggaggctcctggcccagaacaccacacctgcctagcagatgtgtctcctggaagtgggaaagcaggactctccagggagccctggggatacagaggatgcagcccgcgaggccctggccttgaagccttagtgtctctgcaggccccacctgtgattggcccctccagggtcacccaggagggtaagatgcccagggcctgcatctgtgctgtgggacacagcctggcttctgaggcccatggaaacctttctcgggagcttctcaggaccccagccaggacatctgtgcctgtccgtgacagctgccctagaactggccacaggcctatggctgccttgcactgtcagcccccaacgcccgtcgtgtcatcagcatgtctcagatgccttcaagggctgcccactccatgatccttgtccacagccccagcatgtcccctagcgtcagaagtgtccccggatcctgcaagccaaccacataggacgtccacctctgagcccctctgttctcctaccctcctgctgatcacagccctgctgcctggcctcatggtccagtgcatctttctccctggagctgccacagtgcaccacctgcctggctatgcattggtgacccctaggagctccagggggaccttcacacaggcccaggacaactggggagtcctgcctgccctcctttgagtccagaagccctgagccaggctctcttcagaggggtggaggtcagcaggcaccaaggcctgcagtccccaattctcctctcccagctgatctctcttgccacaccctgtgctggcccatgcccgtgagtccgcctggccacccagacgggagctgatgtctccaggagacatacgggacttgccatagcccaggccagggcagtccctgggagacacagggcctgggaggctgcttcacctgcggggctcctgggcaggtgcagtgctccctggagtccatcctgggacctgtggcccagcccacctcagactggccacaggccctctcctgagaacccctgcctaggctctgtagccttagagcctcacctagaagctcccccaggcccctccactgggcagtgctcagcgcccacccctctctagtctagattttagggggagcctgggtccaggctgcccagcccagcacatccccaatacatacccaagccagccatgattgcaccatggggccaggggcagtgggggtggtttggggttggtggaggcatcagggcctgggtcccacagccagcctgggcctcccaggccattgagccctcatccttccagtgctctgcgagcaggcgtccctttgtgtgaggacacctgtggtgcaccccttcagtcaggcatccctgcaacccacttgggggtgcagacatgaaggagcccatgggaggcagcatgatggccctctacatccccaggctcctgtgctccttcctttcagatggcattcattgaaggggcaagtggaagaaggacgggtttcccagcagatgctgcaattcagcccctggcttgggatttgtgtcattgatattattgataaacagagaacacaggttgacaaaagacaagagaggccaccagaaatccatgaagacagagcctcttctggagagagcaggctgttggccaccctgagacccctccccaacttgcgcctggcctggattttgcaggggacggggctggggagctggtgctggtgtagccaccggccctgacacccagccgcgtgaccttctctcgtggcctcacagtcctcccttcaagggtcccaggcctgcccctcgaggccctctgccctccaggagcgcccccatgtccttcccagcatgggcagtgccttacagacacaggaaggctaatgtcagtggagggacacagtgacaagaggaagaatgtgcagcgcccttcaggagcgtggtggggccccagcaggggaggaaggctccaagggggatgacagcatggctgtggcaacgacagttccatgatggcagtgggggtggcggtgggggtggctgacctaacacaggggaggtaactgtccaacaggagccaggctcagccaaggagtacagccaggaaacctccccttccctccccctgcacaccaccctggatgaactgaggggccacccaggcactggagcctctgctgctgtcacagagtcaggctttgggcatggagcagctggcagaggggtgggtgctgaagggcaagtggactccatggagagggccctgatacggggaggctctgctggtctccgggagcaggtcaggacctgagcagactctctgggctcctcaggagaccacccagggcacacccagccctgcaagggtctctacgtggtgccgtcagtgccctgcaccccctggtaggctgcccacacctgtacctgctgccccacccagcaaggctgcagagctgcgtggttcatgcccacctccaaggaccccatggggctgaaggagacagcagagctgcccagctgcaaggttgtcagaggacccctgtttttctgtatttctgacagtaggagatggtgccattgctggaagatgggcctttcaggctggcacccagccccgccccagggggccacgccacctcccacaggctcctgcatggtgggcatgtcccaagccagcctcatctggccaggttgtcactctgggtaaagtgaggtggcagccctgacctgccagcagcagacagtagaattctacagagcatccttcaggctccagggaaggacagagccctgagcagcaaagactccaggaggcattgtggctttggaagcttttcttcaaagcttccaagcccatgttcaggccactttgcacctgagtgacagcatttagctttctttgtgttaggagaaacccatggattgactttcttttcctatttcctccgggggtgaagtatcataagccaggaaaaagtgggtcagggactgtctaggtgaccctggagagcctcgccaggagctccaggggtccatcaagggcaatgggagcaggaggggtggtggccacttcttgatggtgaggggggtgatgaggctcccttaggccctgaaaaggtcagaatggggggtagggagccacctcctgcctggagcagttgatgctcagagctgctcccatgtgtcctcatccctccttccaggtaatggagccatgggtttctaggggaatccagggctctggggagactgggattctgactttgatctttgactgactttgatcagttctcgtgtttttcctgtgcattttctgatgagtttatatctgtcaggagcctcaggaccgtgctaagcccccaggatctgagggtaggaaaaaccatgccttggatttcctgcagacatttgaccatggtggaaggctcaatgaaacttccacctaaacttggcagattgaacacttcattgattttcactctctcccagaatcctatcaaatgatcattagtaaatagagaattccaaaccctacaaagaaaaatacaagcaaatgaacaatgaaatcagtcagagcctaggaggctgaagcacactctgtgggcctggagggcagatggtttcgaggaaacagccctcaatgccacagagggaactggaggagcaaagtgactgaacccccagagctggaacgcaggcccccagcccagcctgtgggaggtgcagcctcattcccaggaaagggtgagccagagaggccctgcttctgggcatatcaggtacgtcccaagaagagggaggcaccaggttggggacaggggagtgaacgtttgtctgggaagcaaagacacagcccctcccgttctccaggaggcagcagcccagataccagtggccagtcatgggctcctcagactggaagtgggaggacttttctcgagggaaactgaacaggcccagagaagagacagtgaaggggaacctttaattaagatgctggctcatccatcacatctccctaaagaaagcttccaatccattttttaaaaataagctttttgttttagaagagctttagatttacagaactatcgtgaagatagcacagagagttctgacacacaccaccccagctcccctgttactaacatcttacattagtaaggtgcatttgtcacaactaatgaaccatgttgatgtgttggtattaacgaaatagcatcttttattctgatgtttttagttttgacctagtccccttttccagttccaggacatcacatgacatttgctggtcatgtctcttgggctcctgatggctgtggctgtttctcagatgttccttgttttcggtgaccttgcgagttctaaagagtgctggccaggtgctttgtagaatgcccttttactgggatttggctgatgtctgataagatgaagatagtgtgtcttggggaggaagaccacagccaaagtgtcactctcatcatgtcacaccaagggtatctgctactaacataatttttcactgtttttttacattttagatccagggggtacatgtgcaggtttgttacgtggatatactgcataatgctgaggtttgggcttctactgaacccatcacccaaatagtgaacacagtacacaacagggagtttttcaactcttgtcccccctccccttttggagtccctagtgtctattgtttccatctttatatctgtgtatacccattgcttaactcccacatataagtgagaacatgtggtatttggctttctgttcctgtattaattcacttaagataatgacctgcatcctagctgcatccatgttgctgcaaaggatgtgattttactcctttttatggctgcatagtattccgtggtgcatatgaaccacattttctttatccagtccacagttagtgggcacatagattgattccacgtttgctactgggaatggtgctgtggcttatcactgtggatgctgaccttgaccccctggctggggcggtgcttgtcaggtgtctctgctacaattactcttccacactgcaccctttggaaggaagtcattaagcacaacttccacttcgggagtggggagtttcgctacctgaccttaagggtggggtatcaacataatttgtttggaattctcctgcacagaatatttgtctttcctcccccacattgatttatttattcagtaatttattgatgtcaatatggatatttattgtataacttgggttataatctgatactactttattttgttgctcaaactgttccagttttggctgttgggagctctttcagttgactcctgtgtctcttttgcatagtcctatcattgtgggttgattttttgtttgtttatttgttttatcatgttcttgctttctggtgctacaaagtgctctaggctcaacttcaatatttcttgccacattcctagaaacaaccattctccaaggatctctggtttctttcactagacaatggtattaaaaaccaagatatgggtgctggggatgctcatttctactgggggcattgttgcttctaggccctctcagtggacagagcaaggaaatctgtatggatgctcacccatgtgtgtatccatgtgatggttaattttgtatgtcagcttggctaggctatggtgccaagttttttggccaaacattagtctagctgttactgtgatagtattgtttataggaactaccctttacaacaccggtaggtctcatctcatccaatcatttgaaggccctaagagtaaagactgaagcttcctgaagaagcaattgtgcctccagactgcagcatagaaaccctgagtttccagcctgcaaatttcagactcaagactgaaacatccattcttgccttaacttccagcctgcaggcttgctctatgtatttcagatttaccaggtcccacaatcacatgataggagtcagatccttaaaaatttctgtgtgtctacatgcacacacacacacaattagttttgtttctctggagaactctagtataacacatatctatgtctctatctatatctacatatctatattaagctaaacgttagtccacatgatgtctccccctctaatctactatcgcatggatcattctccccttccagcacccttgcttcttctgtaacctcccactcaaacagcgagatgctggttcccaccatccaccagacacttatcaaattgtctgatccacatgtatagtggtttcagaattgttaacccatacttctgtggggaaaaactttgccaaaaataatacagtgcttacgtgcctttctgtttgtctttagtcttagaaaaatccgctaattcccaaaattacttaggtcagcaccgtttctcccaccctcttcaaatgagattatttcatacatttgtaatgcagttacattattttgtcacattctgcattccatcctgggatctccaacatcctacatgttaaaaatatacatgcatttgtgtcaagttctgtgtattttgacacacgtttaatatcttgtattcaccttcacaaaatcatacagaatagtttcaccaccttaagctatttcctgtgcttcacttgttcaatgccctactcccaatcccctggcacccgccaatctgtttaccatctctacagttttgcctttttcagaagatatcattggaatcacatggtatgcaattttttcaaactaacaatatacatttattaaagatttattcatttcttttcatggcttgatggttctttttttattgctgattaacattttattgcatggatataacatagttggtttatccattcccttgtgaaaggcattttggttgctttcagtttttgacaattgtgaataaaaccactataaacattcacgtagattttttgtggacgtaagttttcaatcagttggtaaatacctaggagtgtggttgctggattatatggtaatcctgtgtttaactttataataagctgccagactatcttccaaagtgactggcccactttgcattctcaacatcaatgaacgcgagctcctgttgctctctattctcaccagcattaggattgttcatttttagattttaggtattctaattggtgtgtattagtatctctttgttgttttaatttgcaatttcctaatgacaaatgatgatgaacatccttttatatgttattttatgatctgtatgtcttctttagtgaggtgtctgttcatatcatttgatgatttttaactgggtttttttcattgttaagttttaagagttgttttgtatattttgtatacaggcaatttatccgatagatgttctgcggaggttttcttctagtctgtggcttgttgttttattctcttaagtgtcttttaggaaagcagaattgtttaattaataaaagtccaacttaccaatttttttcttttttttccaacaacctcttgtccaacagaacctttttttttttgtcttttttttttccattttgtggagaacaggatctcactatgttgcccaggcaggtctcgaactcctgggctcaaactatcctcctgcctctgcctccctaagtgttgagattacaggcatgagccaccatgcctggccagaacctatttttaatggatatatttgccaatatttggatgagtatttttgaatctatattcatgagaatttctggtctgtggttttcttttcctgtaatgtttttatctgtttttttgaattagggtaatcatggcctcatagaatgagttaggaaatagtccctcttccattttatatcttaaatgtttggtagaattcactggttcttgtatttgtggaatgttattaattattgattcaatttctttaataggtataggcctattccaatgatctatttctgtttctgtaagtcttagcagcttgtgtctttcaaagcattggttcatttaataatgttatcaaatttgtggtcatagagttgtttatagtattcctttattatcatttaaatgtctatggaatcactagtgataactcctctttcatttctgatattggtaatttgtgtcttttctctaacctggcttttggcctacgaatttgattgatcttttctataaaagatagttttgtttttttcatcttttcaatttcattgatttatgttctatgttttattatttcatttttccctcttgattcatgcttaaattgtacctctttatctagtttcctaagttattaattttacatatttattattactgttttttttttgagacagagtctcactctgtcacccaggctggagtgcagtggcgcgatctcagctcactgcaacctccgcttcctaggtttaagcaattcttgtgccttagcctcctaaatagctgtgactacaggcatgcatcaccatgcccaggtaatttcttttgtatttttagcagagacagggttttgccatgttggccaggctggtctcaaacttctgacctcaaatgatctgcctgctttggcctcccaaagtgctgagattacatatgtgagccaccgtgcctagctttgaatttctaatatatgcatttaatgccataaatttcccctttaccactcctttcactgtatcccacaaattgtgataaattatagtttattttcctttagttcaaaatatttttaaatttctttttcctattattttattttattttattttattttattttatttttttagacagggtcttgctctgacactccacaggctggagtacagtggtgcgatcatagctcactgcagccttgacctcctgggctcaagcagtcctcctgtctcagcctcccaaagtactgggactacaggtgcatgccaccccacctggcttaaatttctcttgaaaattcttctttgactcggctgggtgcagtggctcatgcctgtaatcccagcactttgggaggccgaggtatgtggatcacgaggtcaggagatcaagatcatcctggtcaacatagtgaaaccccgtctctactaataatacaaaaattagctgggtgtggtggcacctgcctgtaatcccagctactcaggaggctgaggcaggagaatctattgaaccaaggagttggaggatgcagtgaaccgagattgcgccactgcactccagcctggtgacagagcgagactccatctcaaaaaaaaaaaagaaaaaagaaaattcatctttggctcatgtgttatttagaagtgtcttgtttaatttccatattaaatacttgggggatttcccagctatctttccattattgatttctactttatttcaactgtggtctgagaacatactttatacaatatctattcttttaaatttgttgaggtgtgttttatggccccagaatttgatgtatcttgttgaatattccatacaagcttgagaagaacctgtattttgctgttgttgcatagtcttctataaatgtcaattagatcaagctcattgaaattgctattcaggttaactttagcctttattttacacctgcttcatcaatcagctactgatagacaggtgctgaagtctccaactataatggtggatgtgcctatttttaagttctattaatttttgcacatatatttatttaggtgcatataagtttaatattgttatgtcttcttagagaattgagccaattatttttacatagtgctcttatttatccctcataagtttccttgttctgaaatctgctttgtctgaaattaatataactgctccagttttctttcaattagtgttagcatggcatattttctctatttctttgcttttaacccatcagagtcttaatatttaaagggggccgggcacagtggctcacacctgtaatcctagcactttgggaggctgagggaggcagatcacgaggtcaggagatcgagaccatcctggctaacatggtgaaaccctgtctctactaaaaatacaaaaaattagcgaggcgtggtggcaggtgcctgtagtcccagctactcaggaggctgaggcaggagaatggcatgaacctgggaggaggagtttgcagtgagctgagatcacgccactgcactccagcctccagcctgggcaacagagtgagactctgtctcaaaaaaaaaaaaaaaaaaatatatatatatatatatatatatttaaagggtttcttacagaaaacaaaaagctaggtgttcattctacttctttaatccactctgaaaatttctgtcttttaattgtgtgtttagatcagcagtacccaacctttttggcaccaggaactggttttgtggaagataatttttcaatggaccaagggttgagggagatggtttggggatgaaactgttccaccttagatcaccaggctttagttagattctcataaggagtgcacaacctagatcccttgcatttgtagttcacaataagcttcaaactcctataagaatctaatgccaccgctgacctgatagaaggtggagttcaggcagtaatgcttgctcacccgctgctcacctcctgctgtgcagcccagttcctaacaggccttggaccagtccacagcccagttcctatcaggaactgataggcctttgggaggtgattaggtcatgaaggtaggacttggtactgagaagtggagggggctgccataataaatacctaaaatgtggatgcagctttggagccaggtaatgggtagaggctggaagaattttaaggtacatgctagaaaaagcctacgttgctgtgagtggttcataagcggaaattctgaggaggaatctcaggagaagaggagtgctacagagacagactcaatcttctgagaatatctaagtggttatgagctgcatattggtagaaatacggacaataaaggccattctgatgagtttcagacagaaatgaggaacatgttattgttggacaatggaggagaggccattttatcataaagtagcaaagaatctggttgaattgtgctcatgccctcgtgttttgtggaaagtcgaacttgcaagcaatgaaactgggtatttggctgaggaaatcactaagcaaagtagtgaaaaggtaggctggttcctctcaattgcttaaagtaaaatgcaaaacgaagaaataatttaaaagatgaaattgtttgtcaaaaggggaagcagaacttaaagatttggaaaattctcagccaatccatattggaaataacaaaaaagcctgttcaagacaccttatgataaagagattactatggatcaggcatctcaccagaagcctcatgctatacatcaaaataatggggagattcatcagtcatctaaacagaaaacaggacctaaaatctaagacaatggatgaatacccgcaaagacatttcagagatcatcagggctgcccctcccatcacagggcttcaaaggagggaccaccactacccagcagcctcacactgcaggctgtgctctttgctctccatcaccacactctccagtcatcccatgtgtgctttggtgggccccattgcagcatgcactgcaccaagcaaagctgtggggggcagagccggatttcaaaggatgccctagagagcactggggcccaggcagagaaccaccacaggggcagggccactgcagagagctcccaactaggaaaatatccagagagcaatgagggcttgacctcagactggtagagccactaccatgcaattccaggcccaggagagcaacaggtccacaactccaacccataagagctgtggcatgggctgtacacagcaaagccatgggggtggggctgtccaaagccatgagggcagacaaagctgaggaggagagatcaccatcccagtaggtccagaaggctgtcttccaccccagtgggtggcatcaggtcaaggaatatttctcttgagccttaagagtttggacttgttgagacctctcatacctttctttattcttatttctcccttttgggatgggactgcctgtcctgtaactgtcccaccattgtattttggaagcaagtagcatgtttgattttaaatattcaatttggattgctggagaacaatgccttaaaatgaatcataccttgaatctcatccacatcctatttagatgacatttagataaaactttggtcttgagactttcgagttgatgctagaatgagttaagacttccaggtctgttgggatgagattaatgtatttcacacctaagaaggacatgaattttggaaggccagggtggaatgctgtggtttgcatatatattttgtatacagacaatttatcagatagacgtcttgaaaatattttatttcagtctgtttctccctcaaattcatatgttgaaatcctaacccctgaaatgatggtatttgggattggggtcttttggggtgattaggtcatgaaagtggagccctcatacatgggattaatccccctataaaagaggcctgagggagaccccctgtcccttccaccatgtgaggacatcacaagaaggcaccatctatgaaccaggaaagggttcttcacctgacaccaactctgctggcaacttgattttggacttcacagcctccaaaactgggagaaagaagtttatgttgtttataaactacataatctatggtattttgtcagcagccgaaatggactaagaaagcaggtctgctggtgataaagccccctagtttttatttttctgagaaagtctttgtctttcacttgaacaataagttcactggatatagaaatctaggttgttggaattttttttctgtcaacaccttaaatatttcaccctactactaactgggtgggtagagtgggttttaatctccgcaaaatgccccatcccagaggaattatcactatttgtgttgtctggtagttccctaaaaagctgcatgctcaaggcttgcctttatttgacctgactcagagctcactgtgtataaacagctctatacctaaggtgtttattgaaaaaatgagaaatttttctacactgtagctgcctgagataacaataagagctgtggctaacaaaggctaactaaaaacctttaaagtataaaccaaagataaaatcctaagcccccaactgactgaatgaaccccatcttggccaaagggaacacagagaaacctgaaaaactaaattccaggccatgacgggaagggaggttagatttgcctcgttatactcctgcctttttggagtttaggcacaggtgaccagcattaacattaaaactgagatcataagactgaccaaacagactctttgtggcaataagataccaaattgcaacccgactttggtatagtatcacatgacggatagcagactctgaaggaaataaaaatattttatcccaaaatatatttctttgacatattttgaaatggctgccacaagccagcagattgatgtagaggaaatttgcatctgaagagaatctccattaatgcagccaggccttccctttctaggcctttcctagatctaggagagaatgagagtctgacacctttaaaagtttaaaaagaaacatttactatctattctctctgagggctgccacctaagaggcttcatctacataataaaaaccttgttgttcacaacctccttatcttaactcaggcattcctttctgatttcaagcctttagacaacagcttaactctctcaaccaattgtcaactaaagaatccttaaaacccacctaggacttgcaagccctcactttgaaatgtcccggcttttcgggctgaaccaatgggtactttacatgtatttatttatgtctttactgtaacttctgcatccctaaaaggcataaaaccaaaatgaaacctgattgcctcaggcacacttctcagaacctcttgagactgttccctggaccagggtccctcatattagcccagaataaacctctttaaatattttacagaggttagtttatgttcatcaacaaaaggaaaaactgaaaaatgagatatccataatgggcttagaaaagtgatgacatattcctacaaatctaaacaccacatgcaagtgcagggctgtgtacatgctcaggaaaaaacctgataaagatctagtctctcacttatagcttaacttgaggttctgcatttgcaggaagtgaaagttaaggcagatgtataaactgcaggcctgaacattgacagtgtgctccaacatatacacagagttcccagcaaagactgggagactcattggtccaagacattcaaggaaatttctgtccaatcattagctgaccactataccaactaagaagagacttcggtggctgcacataaccaagaatacagactttacagaattaacccaggaaatccaccaaacaaacaagcagaagcaacaataacaacaacaataaacaaacaaaaaagcttggttaggaaggggaatcttattttccatgtcgccacattatattatttaatatattcagttttcaacaagaaaacataggagataggcaaagaaacaggaaagtatggcccatacacaggaaaaaagtcagtcaatagaactgttcctaaggaagagcagatgagatgttggacttactagacaaagactttacatcagctattgtaaatatgtgcaaagaactaatgaaaatcttgtataaataattaaaagaaagtatgacaacgacatctcaccaagtagatatataaataaaaacatagaaactacaataaaaacaaatagaaattctagaattgaaaagtacataattaaaattaaaaatcactggaggggctcaacacaagattttcacttacataaaacagcatcagtgaaccggaaaatagatgaaataaaatgatacatttgtagaataggacaaaaaattaatgaaataaatgaacagaagcctcagaaatctgtggaacaacatcaagtgtgccaacatacagacaatgtgagttaaggaggataggagagagaaggggtcagagagaatatatggagaaataatggctgaaaatgtgccaaattttatgaaaacattaatctatgtatctaagaagcttaatgaactcctagtaggataaactgaaagtgatccacacctagatccttcataatcaaattgtcaaagtgacaaagacaagaagagccttgaaagtagcaagagaggctagacacagtggctcacgcctataatctcagcactttgggaggctgaggcaggaggattacttgagcccagaagttggagaccagcctaggcaacataatgagtctccgtctctacaaaaattagccaggtgtggtggtacatgcctgtgagccctgctatcaggaggctgatatgggggaatcgcttaagcccaggagattgaggctgcagtgagccattatcatgccaccgcactctagcctgggcaacagagcaagaccctgtctcagaaaaaagaagaaagtagcaagagacaagcaactcatcacgtgcaagggattctcaacaggattaatagctgagttctcatcaaatatcatgggagccagaaagcagtggaatgacatattcaaagtgctaaaaaaaatgacttttaactaagaattctatatttggccaaactgtttttcaaaaagagcaagaaattaagacattcctggataaacaaaaattggcagaattcattattagcagattttcacataatggctcaaacaaatactaatgggagtgctttagctgaaatgaaaggacaccggacaataactagattcacataaggaaataaaagtcaccaattaaggtatctacaatgtaaataaaaatgacaatttgttttgtgacacttttcttctcctatctgatttaaaagacaactacacaaagcaataattgtgttgatgagtttaaaatgtataaagatgtaatgtcatgacaatggcaaaaagaagagataaggaatagatttatattgaagcaaagttctttgtatagtattgaaataaaattcatattaatatcaactatactgttttaattaatatgttattgtagccctcagaggcccactaagaaaataaccatatatatatatatatatatatatatatatatatatatatatatataaaacagacataaatccatttttcccaggaattacattaaatgaattaaacactccaaccaaaagtcagagattggcagaatggatttgaagagtgtgattcaactatacttcaacaagacacatacttcagattccaatacacaaataggttgaaatgaaaggacggaaaggatatgccatgcatacggtaaacaaaacagagctggtgtggctacaccaatatacaagataggccttaaggcaaaaattgttactagagacaaagaaatacttgtataatgataaaagagtctacctattagaaagacataaccaaagtggttatgtcttgccatctaacaacagagctactagatatatgaagataaaagtgaaagaaaggaggaagaaatagttcaacataatagcaggagacttaaatactcaactttcaataatggatagaacaactacacagaagaccaacaggggacccaaagacttgaacaacactctaaaccattagacataacaaacgtctatagcacactccaccgtaccacagcagaatacatattcttctcaagtgtacataggacattctctaggatagatcatatattagataaaaaaataaatctcaataaaattttaaagattaaactcatataaagtatcttctctgaccacaatagaactagaaattaataacagaaggaaaactggaaaattcacaaatatgtggaaaataaacaatgcacttctaaaaacaaccaaggggtcaaagaacaaatcaagagaaaaattagcaaatactttgcaatgaatgaaaatgagaaagtatgtgatatggtttggctgtgtctccattcaaatctcaacttcaattgtatctcccaaaattcccacatgttgtgggagggacccagggggaggtaattgaataacgggggctggtctttcctgtgctattcttgtgatagttaataagtctcacgagatctgatggttttatcagggtttacccttttgcttcctctgcattctctttcctgctgccgccgtgtaagaagtgccttttgccctctgccatgactatgagacctctccagccatagagaactgtaactcaaattaaacttcctttttttctcagtcttgggtatgtctttatcagcagcatgaaaacagactaatacagtacaaaaacaaaaaattgtttcatttaaaagataatcagaattgcaaacctttagctagactgaccaagaaaaaagaagattcaaattactaaaatcagaaatgaaagagacataaacatgcatatatctttatattattataaagaattatttatatattatcctaaattattacttatattcctttaggtatatacccagtaataggattgctgggtcaaatggtatttctggttctaggtcgttgaggaatcttccacaatggttgaactaatttacattcccaccaacagtgtaaaagcattcctatttctccacagccttgccagcatctgttgtttcttgactttttaataatcaccattctgactggtgtgagatggtatcccactgtggttttgatttgcatttctgtaatgatcagtgatgtagagctttttttcatatatttgttggctgaataaatgtcttcttttgagaagtgtctgttcatgtccttcacccactttttaatgagagtgttcattttttcttgtaaatttgtttaagttccttgtagattctggatattagacctttgtcagatagatagattgcaaaaattttctcccattctgtagggtgtctgttcattctgatgatagtttcttttgctgttagttcctctttcttttagatcccatttgtcaatttttgcttttgttgcaatttcttttgacattttcatcatgaaatctttgctcatacctatgtcttgaatgggcctagattttcttctagggtttttatagttttgagttttacatttaagtctttaggccatcttgagttaatttttgtataaggtgtaaagaagggctccagtctcaattttctgcatatggccagccagttttcccagaaccatttattaaatagggaatccttttcccattgcttgtttttgtcaggtttatcaaggatcagatggttgtagatgtgcagtcttatttctgaggtctctattctgttccattgggctatgtgtctgtttttgtaccagtaccatgctgtttttggttactgtagccttatagtatagtttcaagttgggtagcataatgcctccatgttcattctttttgcttaggattgtcttggctatacgggctcttttttggtcccatatgaattttaaagtagtttttttctaattctgtgaagaatgtcaatggtagtttaatgggaatagcattgaatctataaattattttgggcactatggccattttaacaatattgattcttcctatccatgagcatggaatgcttttccatttgtgtcctctctgatttccttaaggggtggtttgtagttttccttgaagaggtccttcacttcccttgttagctgtattcctaggtattttattctctttgtagcaattgtgaatgtgagttcattcactatttgactctgcttgtttattgttggtatataggaatgcttgttatttttgcatgtttattttgctgaaggtactttttgttgctgaagctacttagcttaagaagctttgggctgagacaatgggattttctagatatgggatcatgtcaactgcaaacagacccagtttgacttcctctcttcctacttgaatacctttatttctttatcttgcctgattaccctggccagaacttccaatactgtgttgaatggaaatggtgagagagggcatccttgacttgtgccagttttcaagggaatgcttccagcttttgcccattcagtatgatactggctgtgggtttgtcataaatggctcttattattttgaggtatgtcccatcaatacctagttcattgagagtttttaacatgaagcgatgttgaattttatcgaagccctttcccacagataaccatgtggtttttatctttagttctgcttatgtgatgaattatgtttattgatttgcatatattgaactagccttgaatcccggggatgaagctgacttgattgttgttgataagctttttgatgtgctgctggattcagtttgccagtattttattgaggatttttgcttcaatgttcattggagacaatatgttttataaaatagacataaaaatactagcaaaccaaatcaagcaatgtataaaaaggattatatatcataagcaagtggatttatccaggaataaaagattggcataacatccaaatataatcagtgtgaaacaatatttttttttgtaatagacaaaaaaagcatctgataaaatacaacacctttttctgttaaaaaaaaaaaaaaaactcaacaaacttaaaatagaagagaatttccttaaccttctacagggcatccgtgaaaaacccaaagctaacaccataacgtggtaaaagactgaatactttcccactaagataaggaataagacaaagatgtctgctttcaccacttctatttaacactatactggaggttctagccagggaactattaaaaggcatgcagactggaaaggcagaagtaaaactatctctacagatgacataatcttgtatacagaacatcctaaggaatccacaggaaaattattagagctaatacatgcattcaacaaggttgtgggatacaaaatcattagagaaaaattcatagtatttcaatactttgaatgaacaatttgaaaatgaaattaaaggccagccacagtggcttgtgcctgcaatcctagcactttgagaggccagagcaggaggatcgcttgagcccacgagttcaacaccagcctgggtaacatagggagactccgtcttctctacaaaaaaaaaaaaaaaaaaaaaaaaaaagccgggcatggtggtgcatgtctgtggtcccagctattcgggaggctgacatgggagcatcgcttaagcccaggagatcaagactacagtgagctgtgatcacaccactgcattgcagcctgggcaacagagtgaaactctgtcaaaataaaggaaagagaaagggaaagggaaagggaggaaaaggaaggaaggaaggggaggggaggggaggggagggagggagggaggtaggaaggaaggaaggaaggaaggaaggaaggaaggaaggaaggaaggaaggaaaaagaaaagaaaaagaaaaaattccatttacaatagtattaaaattttaacaaataatttgcaagacttgttcactgaaaactacaaagcatttctggaaggaattagagagcatctaaataaagtaaggcatcccgtatttatgacttggaagatttaatgtttctaagatgacaatactctctaaattaatctacagatttgatatcctaaaaaataaaaccagatttttgtttttcatttttataatttgtttgtttttacttttttgctgatctgatgttaaaattcatatgaaaatacaggagattcagaatagctaaaacaatcttgaacaaaaagaacaaacttagagaactcgtatttcttgatttcaaaacttaccacatttggttatatttggtacaataatcaaaacactgtggtactggcatgaggataagtcaatagttcaatagaatagaattgagagcacagaaataagtgcttacatttatagtcaataagttttctacaagggtgccaagatgattcaatgaggaaaaaaaagtaacattttagatctttccctcacatcaaccatatacaaaaattaactcaaaatggatcacgaacttaaatgtaagtgctaaaactacaaaactctttttttttttttctgagatggagtttcattcttgttgcccagctggagtgcaatgacacgatctcggctcaccacaacctccgcctcccaggtacaagtgattctccagcctcagcttcctgagtagctgggattacagacacgtgccactacgccctgctaatcttttttgtatttttagtagagacagggtttctccatgttggtcaggctggtcttgaactcccgacctcaggtgatccacctgccttggctccccaaagtgctgggattataggagtgagccactgcacctggcctataaaactcttttttaaaaaacacgggagtaaatcttcataatcttgaattaggcactggtggctttttggtttttttgttttttgttttttgttattttttgataaagtctttctctgttgcccaggctggagtgcagtggcgcaatcttggctcactgcaacctccacctaccgtcccgagtagctgaaattacaggcccgtgccagcacactcgggtaatttttgtatttttagtagagacggggtttcaccattttggccaggctggtctcaaactcctgacctcaagccatccaccagcctcagcctcccaaagtgctgggattacaggcatgagttactgcacccagcgttgaattaggcaatggtttcttaaatatgacatctaaggcaaaagtgacaaaaggaaaaataattgataattggattttctcatttcctcaaaattaaattttcagggggttcaaaggacaccatcaaaaaagtgaaaagacaaccccacaggatggggacaatatttgcaagtcatatatctgataaagaactctcaaaactcaatagtaaaaagataatccaatttagaaatgggcaaaggactcattttttcaaagaaatttttccaaaatttttccaaagaagatatacacgataagcatgtgaaaagatgctcaccatcatttgtcaccagggaaatgcaaagctaaagcataggagatactgctgcccattcacgaagatggctagaatcaaaagcagccaacaacaaggcttggcaaaggtgtggagggatccgaatcctctcacggtgggaatggatgatggggccactgctttggagaagagcatggcatttcctcagaaggttagcgtaggtgccacgtgatccaccaattccaatcctaggtatcgtttttgtttgtttttttgggatggagtcttactctgtcacccaggctgaagtgctggagtgctggagtgcggtagaatgatctcagctcactgcaactgcaacctccgcctcccaggttcaagcgattctcctgcctcagcctcccaagtagctgggactacaggcatatgccaccacgcccagctactttttgtatttttagtagagacagggtttcaccatgttagtcaggctggtctcgaacccctgacctcagataatctgcttgcctcagccttcctaagttctgggattacaggtgtgagccaccaagccccaccctaggtatctattcatatctaagagagctgaaatatatttctacataaacacttgtccatggatgttcatcagcagcactgcttacaatcacccaaaagtggaaactgcccagtgtccatcagctgagggcatttatctgaggggagttttcgggaggcgggaggtgagaccgcatgggaggaaagctcagggcctggagtgcattcagcagtggctgggaagactgcctcagggcctgtgtgctccctgctgcactcacaccccttgctccatggagaactgagatgaaaccttgaagattccaaatgcagttgatggaaatggcagttgctgtggttattatctagggagtgcctgtgagaatctaacaagaaaacacacttagagagccccaccagcctcgcggaacaggaagcctgcgttctgtgtttccagttccctcattgccctgtcctgtcctgccctccttcccactcactggctacacataatcaccactggtatcacaggaggtcttggatctgtgtgtgtgagagagacagacagacatagacagacagacagagtcagtgggagccagagagagaaagcatgggagctaatttctccctggctcccaatgaggaatgaggacaggaaaagtcatgcagcatccaggctccttggcgcaactgggtcccaattcccatcctcctgccatcagcctcggtctgtccccaccttgccactgcccccgaattaaatgcttccgagcattttctggaactgtttttctcacatcgcccacacattcttattcccttagtcgaggctctgtccaccttcagcccaccggacagtcaattttcccagccgctggtgagtttctggtttgccaagacccagaggctgggggaagccagacagcaggtggcagctcttccggccgaggagaggagagggacagggctggctcctctagatgaagaggtgagagagctgtgctaggatcaggcggacagtgttcctggcagtagcagcagcaagagcacaggccctgaggtggggctgagctgacctaccccaagagtgaatggcaacccctcaggggccttagagagtgagaaggggtggagagaagtggaggagggtcgccaggggccaggtcatgccaggcctcatggggtctggtggcagcttccagctctattttggttgcaggttttaatcccaaaagttgtgttccctggtcacacttgagaaacgtgggcagctgctatgttgaatggaggttgaaaagaaggggcattaggggggtttgctgtggttgaagtggggatgaccacatgggctaggcgttggagggggcaggctggagagacgcgggaagactgggtgcatgaaatgatgtcccctgcccaggactcgctgaggccacggcaagtgcatgaggaagcacagagtccagggacttctggtctccagcctgagcaggaggtagacaggatgtgaatcccagtgtggggatggatggggcccagtggaacccttgccaggtgggccctgaagctcagggccctctcaggaatcattttatgtacatcatggtgcaggcagggtagtgctgtcctggggcaatgtgaatccattatttattgtggcacagcagtattgtcattttcttgtttgtttgcttagttattgtttatccttgaaatagaattaatggcttgctgaagtatcctttgtgcctagaacaatgctggcacagggcaggggctcaactgatatttattgcatggatggataaatggatgaatggatggatgatggattattggtggatagatggtgtattagtcagggttctctagagggacagaactaatatatataaaggggagtttattaagtattaactcacatgatcacaaggtcccacaataggctgtctgcaagctaaggagtaaggagagccagtccaagtcccaaaactgaaaaaaattggagtctgatgttcaagggcaggaagcatccagcatgggagaaagatgtagtctgggagactagacctttctcctcttttcacacttttctggcagcttttcatattctagccatgctggcaactgatcagatggtacccaaccagattaagggtgggtctgcctttcccagcccactgacccaaatgttaatctcctttggcaacaccctcacagacacacccaggatcaatactttggatccttcaatccaatcaagttgacactcagtattaaccatcacagacggattgatggatgaatggatgaatggataaatggatggatgatggatgggtggatgggtggatggatggatggatgaatgaatagacatggaagaaaaggaaaatagatgcacagatggacagatggataaatacaaaaatagatggacagatggatgatggatggatggttggtgttaaggacttaattgtgtccccccaaattcatactgaagcactaatacctaatgtggctgtatttggagatagagcttttaggaaggcaattaaggttaaaggaggtcctaagggtagggccctgattcaatgggactggtgtccttacaagaagaggaagagacactagagagctctctctccatgtgtgcacagaggaaaggccccgtgaggacacaaggagaggagcctcctacaagctggcaagagaggcctcaccagaaaccagccctgctggcaccttgaccttggattgagtgtgagaaactcaatgtatattgtttaagccacccagtctgtaatattttgtgatgatggcctgacatggatgatatggatggatggagggatggacggctcccccagcccctctgagtcttccctctgggtgcaggcaaccctattcagggacaatgtgagtgcatggctgctgctggaaagaccagtcttgggaactggggttatgtttgacttcctggctcttcagcttgatgctctctagtcccaatctgggacagggctcctttcccacaatgttcaagtttgcagagggaccctggaaaccctgaaggcaatgccttggggccctcacacctggacccattcacacatttccaggtattggtgcctcccccgggagcctgcccagagcccttgcggaggacctggggcaagggaacagggcgggaagctggggcaagggaacagggcaggaagctgagagccgttttcctccgagctaatggaacctcttccatcaccaccagcttagcctttaatcatcctcactttcaagtggaaggcagagctccccagacactggacgggtcagggccatcatcttccaactaggggtgcacagcagggctaatggacgggactggggccaacagctggaaatcaaatcatctcccagaaccacagctcagcagaccctgggggaggggcacctccactctctgcgtagctcttgggtgcaggctggcaaggctggggaacagtcctgaactgctccacccaggcgttaccccctgcacacttcttggcctcaaaactttcgttatatggaagcttgatgagtaaaagttggtctggttgacagcaggtaagggctttctccctttctgccaggctgaccctgggaagacaccaaatggcatattggaatggtccgcttccaccctccccaacctgcctacagtgaccatagctgtgggcggccaccatcctgcccagaccacactgacgacgcttctcacagcctcccctctgacccctcctcctccacctgcccctggcacctgctgtggccctgccaccactcccactgcagtcccagcagaatgaagaggcttgttcaatgtgtggtttcaaggagtgaagtgcaaagcttcccctttcctttgcagtctctcttgatgtgttgtggtggttatgtttgctatttaatggcattctagtcaagaaaagttgaaattataaattatagaaaaaaattaaaattttaattttaatggtaaaataaaatttaccattcatctttatatcattcaatgccaattttaaacataaattgctgtgtaagagcatttaactcatgcagaaacaccaaaatttctgtaactcgtacatgcatgtatatgttgtccttttcagaaaagcgcaaacacttcactgaactaactcacctgattgaatttcacttcctggtgcaggcgcattgtaccaaccctctctacttcagcctaccaggagggaggaaggccaccgtctttccttctccttccatgtcatcctcagcgtcggtgcttgtgcagtacaggtaggtgacagagccggcaaggatgcccagggctgctcctctgtgtttcttaggagcccgctgccccaccgtgctcaggcagggcagcacgtgttggccacgctcaccagctggctgagctccacccggaaccctgtgctggggccttgggaggcctgatggggatgggctcacactcatccacacatcccttctgctcagagggcccagggcttcatttagcacaagttcagacatgaaaccgttaagaattccagcgtagccgcagcccagcactgaacccaatgcctgctcctctgactgtctaccttggctggttcctgtgtcactggaaggaggaaggaacccctcccccgtcaccacggttgttctgttttggggcctggcaccatcacccaacaactatttgctgaataaacgcattgttcacccactgagtatttgctgagcacctactggcagggcgccctgagggcgcagagatacagctgaggacagcgcagcttctaaccttgccatccccaaggtgcgcggagccctcagggtgacccagcttgctgacgagcaagcggaggccgagcaggtgagactggctgagtcagacctgctgccggggcagacgcaggacaaggctgcttttttgcccctggacctcaggatccaggtccgggacgccgcgggcaggggctctggaccgcgctactcgacccctcccccaccgcctgggtctgccaggcaggagggagccgctgcagccaacctgctcctcccgcactatcgattttcaattgacctccgcctcccactttacacttcagagcgctcagcggcctccacacctcctgagcaaggaggaaagccagctgggcgcggggcccctgcttcctccccgagggagtcctcggccaggccaccaccaccaatctcgctcctctccctttcctctctgtaaatgacacgaatggcattgtaaggactataacaggcacttggcctttctaactttttatttgaaaataacatcacacctacagaggagttgcaagaacaggacaatggattcccgtgggccctgtacttaggttcgcccattgttaacaagacaaggactttctctttcgggacacagcatcataatcaaaatcaggaaatttaaccatgatgcagtactcttttctaatattcagtccatattcaaatttcatcattgtcccaaccccgtgtgtccttcagagctcttatttttccctaatgcaggatccgactccagatcacacatctcatttccttatactgtctcttcattcagaacagttcagagagtcatagcatatgattctgacaggcgcagtgccctgctgtcatgctccccacacgcgtgcctgttcatgcacatacaacacatgcacgcgtgcatgtgcacacatacatatgcatacatatgtgcacacacatgtccatacacatccagcctacagcgggcactcgaggtcccctgccatcctccagtacctccccagccctgtggccatcaccttctctgcacacagcaccccaccaagctgccacaatgcctgtgttgggctttctctgagtggcctccctctgggtcagggcccagtcccctgggccaaattatgcccatccaggctggccttgtgcccagctggcttgtcctggccaaacctgctccaggggcacctctagagctgaggcccgggcctgagggcagtcccccagacctatcgggaggcatgtgaagctgccagcacagcaggaaagtggctgagctcagtgactctgggactctccgtgtgacctcaggcagtttctctgctctgtaagccacaactctctctatctggaaaatgggaagaacattattatatgaacactaaatgctcagaaagcccttccttcctggaatgggttagtggtacagcactgccctatcccttcttcccttttgagaagcacagaaccctatgggtgctgtccccagggcactcaggcccccactgctccttggtgccatctgaggccaggaatcagctcaggctctggcaaaaggattcttgtttttcgttcaagcgccacctcttcctctgcagacactcctctgcagtcctgcatgtactgcacgcatgcacacatgcatgtgcagtggtcccagaaggcagccccaaatctacaggctccacaaccccagggctcagagcctggcctagcacagagcgactcacaggccacctggggccatggaaggccaggacctggcaccctccttggcagcagaaaggacagagaaggtgccagttggaggcatggcccgacacagcgacactgcctagttcaagtcacaggccctgcaggaagagtgcagggcttggatccactcatagtgctgttccaatgacctgtggggtctgagtgccccagaagtctcaaacaccaatgcttgggtctatacattcagacaagccagactccatgggtctgacccccaggcagcctcccgtgccaccttcccctggatcaggcgcaccatccacaccttgtctggcttcactcaggcctttctcagtgctaacccacgtggctgttggtttgctgcttaggtgtgtgagacagtaacatgcatcttctcccagagctcacagcctgctggctttatctggtagcacatctgctagtgctccactgacctgtctatttttcctacctcattagggcaactttgtttttctgaaggtgattatgactacttactgaacttgaatatactaacagatacttctcaagtatacgtctgaagacgctgctctgagatgcacaggagtgtagatgagacgctgtctgagatcagagtttacttcttgcaaggccatcagaggagaggacgtcatggaggatgtggtcatgggtagtgcctctggctccggacaggcacagtgtgcagaggaccttgcaggagcatgggtatgaagggaataatgagcgagggtaagccaagaaatgttctagggggcagagccagccaggggccaagccaggacagttggatgcagctagacccagcagggcctccgcccgggttggactctggtagcatccactgcagtctccatccagccacgtgctggggtcacaaggcatgaacatgatctcacgatgaaagctgtctgtctgtgactgtgggagtgattgcattcccatcctttcaagctttccccagcaggagtggcaacgctgagcctcactccctggggcctactgtgacagacgccatggccagctcctcagggtggaggtgagggtgagggatgcagaccccacaaagttcaacccagcctactcttcactgcagctctgacttgcagatgtcaatgggctccttggaattcttcaaattcagagtcacagcccatttgagggggcagcctgaagctggttcgctggaacctttttctgtccacgttgagtgcttgctagaagctatgagagcagctccttctcactgttgtgatggcacaaaccacagccttaacccctgtgtccgcctaggctggagttgggctccttgacccctccctctccctcacactccatacaattaagccccattcactttactcccataatccctctaatgagcaggctcttcacccacctcctgccccctcactgtgctgcccagtttaggccctcatgagccctcacattgattccctgcctccagtctcaccctctgcaatttcctcccaacttaagtgcaaaacagaagtggcatcatggcaatcttcagtctgaaatatctaatgggcattcaggtaacagaatacttgagcatgggcatccaactgcctctcccaaatgctagcccaaatgacttcagaaatagaaaaggaaggagaaacctgtatccattttggaaatccatcagggcaccatttacacgccacacgcagagccatttccataagttacagtgcaggcaaaaaacagcctgaaggaaacttgcaaccctccttgctgagcaagtacaggcatgggggaagaaactgcaggggcctgagaaaggcccaggaataacccagctatagaggatggtgcagatgatgagggcatgacatatggaacctcttagcactgagggtcagcatgtctcaaaagcagaccagggcaggggggccagggcaatacttttcctgaggggtgcgcagtagtccaggaaacaggctagacagacaagggatggaccagtccaagtagaaaattaataagaaaaataggttcaaggaagaaattcccctgtacagagaaaaaacaccctgttggaactgaccagaaccatctcctccatcttgggctctgagttgattgtgaggcccttaggcccttagcagaggattctgttgttatttgtgtggacagcaaggagaagcaatgatgtaaagaaatgccatacttgtttgaggcaaatgccagtctttcatagagaccttgcaattcaatgctaggtcaatggaaacagcagatatgagaaagagaaaggctttgcaaagaaaaataaaaacacacacttctcaaaagatagatgaagagtgatgaaaatgatttaccaaaggaaacagaaattgtcttagtccatttgtgctgttataacaacatcatggcctgggtaatttataaagaacagaattttttcacagttctggaggctgggaagtccaagctcaaggcatcagcaggtttggctgtctggtaagggctgttctctgcttctaagatggcttcttgagtgctgtgtcttcacatggcagaaggccgaagagcaaaaagggtgaaatccttccatcaagctctttttttttatttttaagttttataggtacataataggtgtatatacatagtagctatatatatttatgggttcaatgagatattttgatataggcatgcaatatgtaataatcatatcaaggggtaaatagagtatccatcacctcaagcatttatcctttgtgttttaaacaatccaattatactattttggtctgtcaagccctcttataagagcatttaatcccactcatgagggcagagcccttatgactgaatcacctcccaatactatggcattggggatttaattttaatatgaattgtggagaggacacaatcatttaaaccacagcagaaataaatctcagaaaccatccatttgacgttcccaataaaatataaatttaaaaatagctcttaggagtagtgacattgccaaaacggcagagtaggaagctccaagccttcattcccccatagaaacaccaaaaaacagccagaaactgggtatttaaaactttataggcactttggagagcagaaaaaggtccacaatagccatattcacaagagtaggaagttttctggcatttttacacactcttgcctcactcccttcttggcacagcacagccttggtctgcaggaggccacagcccaattctcagtttcctccatcaaactggagggagcagaacggatcttagttgcgatgttctttttttttttttttttttttttgaaacagagtctctctctgtagcccaggctggagtgcagtggtgcaatctcggctcacggcaagctccacctcccaggttcacgccatcctcctgcctcagcctcccgagtagttgggactacaggcgcccgccaccatgcccagctaattttttttttttgtatttttagtagagatggggtttcaccgtgttagccaggatggtctcaatgtcctgacgttgtgatccgcctgctttggccttccaaagtgctgggattacaggcatgagccgccacgcccggcctagttgcaatgttctaacctgtgtaggggctgcctgaagaactgctctcttccatgcctaaatcacatctcaggcagggaaaagtggcaaaactcaggactcaagcagggaaaaaacaatgggcattgcccataaaggtttcatggggactacagacccatagacacctggggtaaaagattacaggtggagacatacaatagaacatctaaggtcccaaggaaaactagggtgagactctttggaaaattaagacattcaaaagccactgtgtatatagacaaaattgggggtgggggtgcagaagcacacacacaggcacaggcaagatgcatgcttaaaaaatacctgagaaactttcacatctggctgatcttaagtctcagagcacacccagcaaagcaggaaatgattgccctggtaaagagtcagtctgaaaagacagaaagaggtgactgctttccaaatgcccaattttcaacaataaaaaattataaggcatacaaagaaacaagaaaacatagctcattcgaaggaacaaaataaaatggcagaaactgtctctgaagaaacatgggcattgcacatactagacaaataattcaaaacaattctataaatatcctcaaagagctaaagaaaacacagataaagaaatgaaaagaatccagaaatttatatagaatcaaaatgataatattaacaaaaagatagaaatgataaagaaccaaacagaaattctagagctgaaaaatgcaataatgaattggaaaattcactagaggggttcaacagcaaacttaaacaggtagggacttgaagacaggtcacttaacactagtctgaggagcaaaaaggaaaaagaacgaagaaaagtaaacagagcctaagagatttataggacaccataaagccaaccaatatatgcataataggagtctcagaatgaggagagagggaaaagggtaaaagagtttacttgaaaaagtaacagccaaaaacttgccaaacttttatatccaaagaaattgatataaaaatacaagaagttcaacaaattccattaggataagcccaaacaagcccacagaaagacacactataatcaagccacattataatcaaacctttgaaagacaatgtcaaagggatagtcttgaaagcatcaagagaaaagtgactcaccaaatacaagagagccacagtaagattagcaatgattttcctagaagaagccctgcagaccagaaagcaatgcagtgatatatttaaagtgctgaaagaaagaaaaagctgtcaactgaacattctatacctagcacaactgtccttttaaaatgaggaagaaattaagatattctcagataaacaaaagctgagggagctcgttaccactagacttaccctacaaaaaatattaaaaggaattatttaagttgaaattaaaggatgctaaatagtaactcaaagccatacaaaaatataaagttatgcaataaagctaaatacatagacaaatataaaaaccagtattattatcattttggtttgtaatgccacattttattattttatagagtttataagacaaaggcatataaaataattatggatctatgttaatgggaacatatataaagatgtaatttgcgacatacctcaataacataaaatgggaagagccagaaggttgtagagcttttatattcaattgaagttcatttgttatcagtttaaagtagattgtaataactttaggagttttatgtaattcacatagtaatagtaaagaaaatatctatggaatacatacaaaaaaaatgagaaggcagccctgatgtatggcacatatatatttataattgttatatctttttgttgaattgacccttctatcattacgtaatgcccatctttgtctcttgtaacagttataagcttaaagtatatcttatctgacattaatataatcacgcttgctccttttagttaatatttgcatgcaattttttcccattattttactgtcaacctgcacacatgtcctgtgcccttaaatctagtgcattgtagacagtatacagttggatcatagtttttcttttaatccattctgccattctaggtcttttaatgggggaagttaatacatttacatttaattaatgtaattaataataaagaaggacttactattgctgtttagtagtttgttttctgtatgtcttatagcttttttgtccttcatttcctcccttcctgccttcctttgtgcatagctgactttttgtattgacatcttttgaataccttcttatttccttctatatgtattctatagatattttatttgtggttactatgcccaacaccactaatcattaggaaaatgcaaatcaaaaaccacagtgagatactatctcatactcattaggttggctactatttaaaaagcaaaaatgaaaataaaaaatgttgtcaagaatttggattgggatgtaaaatggtacagctgctgtagaaaacaatatagcaattccccccaccttctccaagaattaccatatgatccagcaattctgcttctgggtatatactcaaaagaattaaaagcaaggacttcatcaggtttttatacacctatactcatatcagtgttattcccaataatcaaaaggtgaaagcaaccgtagggttcactaatagatgaatggatacacgaagtgtggtatatctgtatgatggaatattattcagccttaaaaaagaagtaaattatgatacatgccacaacaaggataaaacttgaagacattatgctaagtgaaataagcaagacacaaaaagacaaatatcgcacaattccatttacatgaggtgcctagagtagtcaaatccacagagagaaaatagaatggtggtcgccaggggctggcaggggggagaatgaggagttgttgtttaatgagtatagagtatcagtttgggaagatgaaaatattcagagctgaatgatggtgatggttgtacaacaatatgaataatgtacttaatgccattgaactgtacacttacaaatagtcaaaatggttattttatgttatgtgtatttaccacaattttttaaacagcttttgaagtaaaagataaaaatgaattagatgactgactcggatgaggaaaccagctgagctaaggaaaagatgaaacgactgtaatgaaacaaaaagacttttctctgctgaataccaaggggcttagggaaggcacagctcctccttaggtgaggagtagaatgagcaaggagcagagatgtatcactggggatctgcacccaaggaggcaggtcacacagttgaggttcacactttggaaaggatgcaaccactgaggttacatggaaagaaaggagagacaaaaggctgaaattaacctggaacaaaagtagcaaaatgaagctcagaataatgagttattggaggaaatggaaactaaatccataaggagatgccgctactagtcactactagtcatttagccatacaacagctaaaactaaaaacggtgacaatgccaagtgttaacagggatgtggagcagctgggactctcagacagtgccagtggaagtgtaagttggtacaactataacagaaacccagttgacaggatctactaaagctgaatatattcacccctataatccagcaatttcacttctaagtatttacacaagaaaagtgaaaatttatgatcaaacagccttgtacgtgaatattcatagcagctttagtcataatagcaaaaaaactgaaatgaatccagaagtatcacaacaggagaatggagaaacaaactgtgatatgcccacccaacagaatactgcttagcaatagaaagaaccaaggtgctaacccacacaagaaggacgaagctcagaaacatgatgttgggcaaacgaagccagccaattatctgacattctagaagagtcaaaactacagtaacaggaagcagatcagtggttgcctagggatggggcgggaggcttgactgcaaaggagtacaaagcaactttcttgggtgctggaaatattccagatcttgatggcagtggttacacgggtatagacatttgccaaaatgcatcaaactgtccacttaaaaagggtgcattttattatacaaattatataatacagttgttgttttaagtgaaggatttgaactttatatccaggacagatgagagtgggaatgagacatggattggggacagagagaagtataagaaagcaaggaactcacaggaactatagagggctctgggttgggatctgggtccagcttatcagctctctagaggcaaggaggtccagtcaacacatgggatatgtcaggaaggctacatcagagttcaatactaagctgcaagcagtgaagtgcagaatcagtacttaagaaaaacaatgtgggatgtggaacatttgcacaggaaaaggtttcaagacataaaagccatgcaagagaaaaggagagctgtgcaagagcgagaagagaggcccttgtgtgggccactgatgtccccggggttgaggccagaggtggagcagcatgatctggaaggaaagcacaggcgtcaggttgcaacagaggctctcatcttgagacagcaagctgagctttagggaccagggagaccatggctggtggtcgccgcctggaagctgaggacagagttgtttatgatgagcacccttctagaacatccaccagcgtttgcagcccgctctgggacagctggagaaaatggcctggaggctggtccagggtgagcagaggtccctggcacacgtgggctcctaccaggagggctgtctcctatggcacctggcctgagtcactggaatggctcctgagccccccacccctaggccctgtgctcctgcctgatgttgcccatgcctgcgtgagcctggctggtgccaagagccaaagtgctcagatgatccagtgctcatggaggaccactgggcccttggccaggagcagggggccctcaaaggcacctccacccttgaccgcccctcactgacccactcctagctctgcacatatgtgctgatagcctgaagccatgtacctcctggtccccatctctaggcacccacgggagctaaaggtgtggccttgggaagggggcttcatggaggctgcagtgcctggggtctggatgcaaattactttttggggtgggatgagctggggtctgggctgcacgccctgcctggtctgtactcctgctgcactctcacagcaatgggaaggagagtcaggtgggagctgcggctgtccccggcccctctgcaggtcttctgctgtccattctcacagagggtggtgggaacggtaaatagaagatgacggagaatggccaggtgaattctaagcctgtgatatctgtgtgctgttatttttatagctctgatgtaaacctgacttctcatccaacccagacatggggtgtggagaacggcatagagctcagaactggcctgggtgctggagtggggcatgggtgggagtggaccaggctgacctctggctgggcccagagctgcaaggtccccaagcggtttcctggaccagggtgagctggagaccaggggggttcccagaggccagagggaaacctgaggcaagggcctgcggggcccgagcaagtgggctctgggaagagaccaaggctagatagaatccagcactcgccactgggctgtcctctaagggatggggtgggtttgtgaatgtgaaccccaacctcgtgcctggcaggggcccacagcaggcccaggggcccacactgtcctaatacagaagagactgccaccctctccaactccactcaccttttttgttaaatattttttcccccaactaattcccttggttttcctttgtgagttttgtttttgtttttgtttttgttttttatgcttgaagttttaaaactatagaaaagtacagggaacagacaccagcatatccaccaccagcgcctcatttcaaagaaagggaaaccgaggcagcagcccacagctggaggcctaggagtgtccatgggcatggactgtggagccgctgctcaccagggagcaaattgttctgccacctccttactcggagacaccgagcccagcccgagccacagggtgacaggacgtggaggtcacaataacctcccaagctcactgtgcttattgtgtttaaggctttatcgcttcagtccttccatacagcactgccactgggacttgggtggctccctgggcaggcagggctgaagctgctccaatgaaacagctgtggccaggaggctgggagggtggagggaggcggggtcctcatccaagcatccacactctgaggagggcaggggccactcccacccaaggacctgcactccccaaggtgggagagcctttctggccaccgatgcttcccaaaggcccaaacccactccaagggcacctggagaggcttcaggtcctgagccccctcagcattgcacggtacagcctcctggaggaggcagcaagtgaactgcagcctgcctgtgggcacaagaggaccatgtgtgaccccagctatgcccctggccagtcctccatggccccacaatgcccttctgccctggatgcagtgggatgcagagggcgggtcccatggaggctgatgcgcactctctgcagctgtcggcagggctctgaagcccctgctcctctccagcttccaaagaacctgcagcatccctggaggctgtggtatctgtcactcagggccagaaaagctccagggtgaaaaggcaggtccctcagagaggcccacacccagtcgctcactcaggcctaaagagagctcagactcagtcatgggagccacagtccctctaactcctgccacaggacaggcttctcgggcccaagtcacatcacaggaattgagggagctgggaaggagtaggtcagctaggggaggttagcagcttgcccaaggtccctggctgagtgcacctccagggccgggggtattttgcacttggctgcagggagctctccacccaggaggaaagctttctcaccactgctcttgctggcttctccctgagctcctccaggctccctacccaagctggtgtccagcagctggactccagggtcccctgacacgcacctagtgccctatagaatgcatgcttcacccccactctctccgggtggggctgccctgagcatttgctgtgcattctaattttcagagggagcctgagaacgtgaaatggttcctgtccctgttttatcgatgaatgtactgagactgctgagatcgagccacagggtagggtcatggagttgggcctctgagtttccaaagtgcttaggcagcccctgatgctgtctttttaaaaaggcagagcaaagcctgcctcctctctctgcacagacccctaggtcccagaggagctgccgcacagccacatacacacacacccacgcacacatacacacacgcccacgcacacatacacacacatgcacacacacacgcacacacatgtatacacacacacacacctgcaggagcccccccccccccgcccccaccgccagcaggccagccattcccctggctccggggagctaattacatcacaggaaactgcggtgtgagtctcacatcatcatggtccccagtggagcgccgagacagaacacatgtggtggagctctgggccaggcccagctgcctcaggtgtccccccagctggagcgcagccaggcgctccatgcagctcagccagggaagggccttcttgctaggccaagggtggttagagtggttctgagagaggcctcgggcccaagcagcctcctctgcttccttcttgggtgtcctggcctggggcatgttgtccccaaaacaggacaacgttagtcctgtcgccctcagggagggtatgtgagaccctgcctagaaaggcggcacacaacacctggtgcagaggcacaaggacagtgtctgtgacaacagaaacactgtctctgcccacaaggggcacattcagggacacgagacccacgtgcccgaggctccatcctcactcatggcctgggacacacgggtgccactctcttaagtgacactgccagtgagcccatggcccatgggaccagaattctgctggggactccaaaattcctacagagggttggagggctcaggcagggcactccaaagagacatgtgagctgaggctgaggggagagggcgagtcagatcggagggagaaagggcatggggccgagaaaacaacggcaagggcccctggctgcaagctccagccagagaggtgggcagtgcggcccaggaggaaacatggccggagaaggaggggacaggtctcaaagggctgggccttcagaaagaaagcgggctgtatcccactcacagcaggaagctaccaaaaggtgtgcatgacagtgacatgcacacaagtccttttggaaatttcatgctggctagtattggggagggcacaggatggtggtggctccagggggtgatggtaacgatggagatgcgaggggtcccaaggacagaagacctgccatgctgtgggggtggggtgctgacaggacctgccatgctgtggggtattgtggggtggggctgacaggacctgctatgctgtggggggaggggctgacaggacctgccatgctgttggcgggtggagctgataggacctaccatgctgttgggcagtggggcgctgacaggacctgccatgctgtggggtggggttgacaggacctgccatggtgtgggggacactgacaggatttaccatactgttggggcgggggtgctgacaggacctgccattgctgtgggatggggctgacaggacctgccatgctcttgggggcagttgacaggccctgccatgttgtcagtgggggttaacaggatctgccatgctgtggggggttgggctgacaggacctgccatgctgtgagggagcgctgacaggacctgccatgctgggggagctgagaggacctgctctgctcaggagggggaagggggagaagacagagagaggagggtagaggtagtggtggtgggggatgaagtccaggcatgagtgaggaggaggctgggttagtgcaggaagctgtaagtagacatggaagggaagagaggttctggggtagaatcagaatcaaagaacctcagaaagttcagtggagaaggatcctgtggttttctatctcccgaagtaaaatgagaggccagattttacctctaaccgccattcactataacccatccctctataacccctgaagcattccctggagacctcatgggctcatggaacacacattgaaaaccctgcagtgggccagtgggtggcctagagccatgtcatgggttagtgctggagcagggcagttccaggacattagaggccagccctgggccagctccccaccagctgaggctgagtcccaccagcagcatccctcacctgagagctggcctgaagtcctttcttcctttcccctgtccctgtttcagtgaccagctgctcctccctcctcctgggcatgctccactaaggcaggcatgcaaaggccagtagggaggcggcccctggactttcccaggcagacagcagtcccagaagagcgtgctgaaggagggacagactgactgctgcgtcctgggtcacccccacccaactcagcccacctcccaaagctggagcccctctcaatgtctcagccatcagggcccaagagctggggcagcttctcgaagctcaaagctggcaggggcaatgccaggctttgctggcaccagagggaccctgtgggtgtagcactgacttcccccgaagccagccgctgtgtccacgcagcctgaggacccaaggggaccttctggctgtcccagcaggaatccccacatgagtactcttgagccaggtgcccagccagcctggagatcacccaagatcctcaaaggttacagagggagttctgcctcctcacttcctggtcctgcaccctccctggagcaccccaggagactgcccccatactagccttgggaacatgggcaggttggagaccagccaggaatgagctcatcccctctgggggctgcctcctcatggcaggcccttccccgtgagggagagatgggggtcttccagttttctggctctgcgtggctatccaagaccacagtcctggggggcctgggaagcccagggtccttcaaccttgggccaggccatgggaccattccccagggcagagccagagtaagtgcaggcaggaaagtaggggtcacttttagaaatgggacctatctgcaggtgtggctccctgtcctgggaggagaggacagttacatttttttcttccatctatgcaatacttaaaggccaagagggcatttgaagcagacctcccatgttcactccaagtcacacagatggcctacactccctcattcatgtctctgctccctacttaggaggggctgcagccagggtaggggaccctcacccatctcccagtgggctctgggcactcacctttgaggtcaggcacagccacccctccctctgggcttcagggaagtttgggccgggtaggcatagggtgcctcctgctggcactcagggccaaggcacggagtcccttcttgggactgtggccacgctgagggggctgtcatgccatgagtcagccagctgtcagggacctggcccccaattcttccctcctgccctccccacagcctgcttcacactggacaggtgccccgactggctggcctgggtgtcctcaggggccacagcaggtaccagtggccgcagcccctggagggatgtcattaaagccagatcagccacaatccctggctctcacaatcccagccctgccgctgacaaccctgacgataagtgcaccccaaagaggaaatggggcccagaagcaaagctctgtgccatcagttcagctctcagacctctatgggccctgccacgacctgatgggctccattcctgatcaggagctgcactgggcatcagtcgcatgcccatggggtgggcaggggtgctcagcacctccagggagccctgactatgcaaggcctccccacgtcagatgtgcttttgcccctctgcttggagtcctagttctgccccacgtgtgcccagaacaatcagtgtctccaccctcaggccaagagcctgtgaccttgggttggagcctggccctggtgcaggcctgcggatctccttccacctggctctcagcctccagctacagggagtccccagatctgacccagggggccgagaccccaaagaagaggcctctgtgtcccaaccttgctgtgaggcatggtccactgttggaggggctgcagccactggatggcttctcatcgccagccctcccccgagggcgcaatgagactgctccactgtgactcccatggtccccgagtccctgtggaaagagccccagagggaaaggcggggtggaactgggctcccagcccccctacctgccagggacatgaccgaggcccctgggcaccccactttcaccttgggaaggaggcagcatggcctgtgcagttgcccctcctaatccacaaacgtgtggcctttcctgctgaatatgatggtgactgtcagcagttggtctcagcaggatcatcgtgccaattaagatggaaatgccaccctgtgggggctcccccctctgccagggagctgaagtggagggagtatgtttatacccaaatgcaaagatactgcccagcacagacttctgtcccagggggccggagagggatgtcattaaggccagatcagccaccacccctggctctccctgccgggaattccctggacagcaggagtaagtggcccttccttccttctctgcaaaagccccaaggtcacaggcacctctgaaacatgccccacactccccctgcttaccaggcctcatttcaggacctcctacccggactacactccaggcccagtggcgagacagagacacctgcagggctcccggattgggggcggtgaaaacctgcacggtgcacgccccagcagaccatagtcctcatgccagctggccagcagctgcacagaggctggtgggaagcaacttcctgacacagtcacccctccccagaagtgccctgtgaggccagggaggtgaggacaggcaacccctcctcagaagtgccctgtgagggctgagggagaagcacagtctcagctgggcctggccatggagacggatcccagtgaacaatattgattgtttgtgcaaaatggcaccccagcccctcagcctgcttgctgccagggcccctggtggaagctgacacagacacaaaggagaggaaggggcacagtgcagcaaagccggaggcagagcagtgaggcacagctgggggcccctgggccagcacaggcatctgaggcccagccacaagaactgcagtcccatagaggaaggggagggtgtcgcctcactcccaatctgtgcagcccctcagagccctgcacagggccaacagagtccgggagggtccctgtgcctgcaagggctgcggcctaggcctctgcagaacagggggaggggagcggccgcacccctgtctagacggctcctgctgagtactagctcctcacctacccgccctgggtgccacgggccccaaggcagagggcataagctctgtgcaaacatcctgccttctccccaggatatttcctttaataaaacaccatggaaatgtcagctagtctaaacaaatagccaaggttttcagaggacgagcagcctgcataggagagcctccagggcctgcttttcggggtggctttgggaaattgtgtgccagaaaggcagtgggagcccttcctggtggggcgagcactgggggttgtggtgactgagcccaaagaggcagggcctgcgagttcccctgggaggaaggggcaggccctgagccgggtgcagggtggctgtccagggtccctgaggagcctggggccttcagatgagggctccctcctgaggaccctcagaaagggcctgccccagggacacacgcagaggtgggggtgggaggcctacagcacatgcttctcaggacaccctccttcccctcccactgcaggagccacttctgcagccccatcctcctccttgtccataagctccatgttaggggaggcccctgcttggggaggccccaggtcggccgggggaggtgagaagtccaataatggggtgaaacttgcaaccccgtgcctgacaaaatgtggcccaggcccagcggtggcagggttggggtaggggtgagatacgtgttacagcccccggcagcatccagggcctgcatctgtgtgggggtcaagtgttcccgtgatcctactgcctgagcagcgggccgtggcatccctgctcttccttggcagggcagacagacccagctctatccatgtgcagggcaacgtgggcagggcccagactgcctccccagcaaagaaagattttcagggtgtggatctccatgtgggttcagcctctgtgaatggtgtgtccgggaaggggccacacgtgcaagaattgctgaccctgcctgggccagtgcaggagagtgaggctgggcttccaggcactgggctcgggctgtgccaggtaggccaacgctcctcaggaggccagcagatgcctgcagggtggcagtgagggtggtcccagcccttggggcctccatgcagccacctgcatctgtggccacgggtggaaaaggtgagcccacagcaggtgggatggccaaggctgagcaggtccacaaggagcagagatggaagccagcagccagctctgcaccaaggcagggcctctgggcaccgcctgggaagaagggagtgggctctggagtcctgtatgctgtgctagaatcccagctccatttcctcgcctgtgaacagggaagtggtttctagccaatgcggtgtcagaaggagagaacaggatgaggtgcctgggcacggctcagcactgagcactcggtccctccccagtccctctgacgaggcacccaggcaggccctcccctagcagaggacaccatccttgggcctctgggtggcagatggcattttctcaaaatgcccacaagagtatctccaatcccacacattctcagaaccttgctactctccaggagcacacctgtttccccttccttggaccgggtgcagggcagaggtggtgggtagggcccgcagaggccatgcagagtgaaatcagagactggggcagatagggcgactcatttctgcctgattccctctctagggaggttccccttggagcctggtcccatgctgtgaggaagcccaggtccctggaaaggccacatgcaggtgtcccacctgagggcccagcagcagcctccgctgccagaccgagcaccaggagccctcagatgcctccagccaacccagctgacacaagtggagcagagacacactgtccccaccacaccgggcccaatgtgcagtttggggagcagaattaatattgtcagtgaagccactgtgctgcggggtggtttgttaagcagcagcatgacggagcattggtgcactggctgagtgacaacatgactgcagcgcccccatctctgtcagactctagccaggggacggggcccactcagaaaagcctgtttcaggagacaggacctggtgaccattctgtgcctcccatcccgaggccccagacaaggctaggcttggaatccagaatgcctgggccctcaggacacagtgccctgccccccaggagccaagtgctgagacacgcactgttcaacggcctcattcagaggatcatgcacccgggaaccccacacagtcaggactggtgtttttcgtaggaggaatctgaggctccaggatgggctgagtcccttgtctaatgcgccctgcttgaccttggaagagacacgctggggactgatttaaagccgccactccatacgttctccctgcagctcccatgccagccactgccatccctgctgcaggagcacagctctcagccacagacgcccccatcaatcaatatttttaattacttacatgattgactaataaaattctccaccaactaattgatttttttgatcagagagagcctttgtttttattaaaaggctacttagatgaatttttttttcacttaagtgggaagttgtatttcttttggtcattttggaagaagaaaaataggagggggctgggacaagggaagaccccgaggccaagaagattacaggcccaaactgagagacccatgataatcatcagaaccccttcaccatgtgcccaccaaacacccagtggctcggctctggccagaggagccctgtggcatgggtgggcagactggggacacataccacccaatcgccagcagcttccatcatttttaaaggtgaactgtaaacttttctctgcattttaataaaagaatcgggcttgaaattataaaagcaactcattcattgtgtacagtttggaaaagaaaggcaaatctcataaaactatgaaagtgggcttcctggcacggggcccatggtgcatggggcaggtgacctgaagctgtgagaagaagctgcagggttgacttcggtttcccaggggcccaaggccccaaagagccatgaccataaaaacaatctggacagccacccaccacccagaaaactgctcatgggctcacagatcagtgggctttttgttgttttcctttttcttttcctttttatttatttatttattttagagacggggcctcacactgttgcccaagcggcaggcagtggtgcaatcatggctcactgcagccttgaactcctgggcttaagcgatcctcccacctcagtctcctgattaggtggtactaaaggtgtgtgccaccactcccaactaacttttaaatatttctggagagacaaggtctcactatgtggcccagattggtctccaactcctggcctcaaactgaccctcctgcctcagcctcccaaagtgctggcctcccgttttcatttttcttttaccagattggcatcttactgtagatcaggtgtggccatgttcctccacttgcagtgacctttaaagaggtgtttgtaagtggctccagggcagcccatcctgggacctcttcatgtggcacacactgaggttgtcttccctgggcagctgctgggcacaggatgatgctgggcacaggatgattctgggcagctggtagggccagggagcttggcagcgacaattagggtaagggatggtgggcatgtttggtgaaggaggggcagggtacagggtccccaccacagccatgggatgctccttctctcctggctggagggtctcagccagggggacacagtggacagggggtgttgcccccagctccacactgggcctgccactgcctctgcctgttacttccacagtcatggtcacccactgatttcactgtgacctcatctcttgttggctgctccatgccctacgagcagagcagtacccaggatatggtggatgctctgagaccaagttacaaatgcttgctgagtaaccctacagaaatgaagaacattcttaccgtggcctccacatggcccttctgagtggggccctggggctgtggggaggatgagcctgctcccttaggagggtcactgcagatgtgcagaatgacaatggaatgcagaggtgatgggggcagagctgtccctgtgtcacagctcatccacacagactgggtgagggctctgtgcctcatgccagccccatgcacagaactgagtcctcgaagacagagggactgagtgactccccaggccacacagcctgtctggttctccccatgggacgcttctcaggctcacccggagctttcaaaacagattcctttgcccgtgacctgctctcagcctcatgtgaggcctcagaccagcagggttggaacagagctaatgacatggcagggaaacatgtggatggttagcgacatgaaggcccacccagctggccctagagtgtctcgcctgcctgacagctccagtctgtcaccctgactgggcatgtccagaagcctggccctccgtccttggtgatctcatgctgcgtggcttgcacccgctgggagccgatgccaccacgccaattgctgcaagcctctgaaaggcacctcgaggtgtcctgatctgtccccaacatgcaacctgcccctagatgccctccccaccacagcaggaggcagttttgtcctgctcaattggaaaccctgggagctgagtgaccctgccgtttcccccgcccactgccagccacatccctgctgagaaaaccaagaagggagttggagctttgatcctcactagctggtactgattcccccacctgcagcagtgtcagagaagaccacacagaaagccagaactcccattcccacccagctgtaatgaggagtccccacctgcacctcaggtgtcagcagaggctgagtgagaatcccaagcttctacttctacctggcagtgagaaggtactgcctccctttccctgacagaggctgacagaaagtaccagctgaaacagaggcttaaataagacccagaagccgggcgtggtggctcacgcctgtgatcccagcaatttaggaggccaaggcaaacggatcacaaggtcaggagtttgagaccagcctggccaatatggtgaaaccccatctctactaaaaatacaaaaattagccaggcgtggtggcgcacgcctatagtcccagctacttgggaggctgaggcaggagaatcgcttgaacctgggaggcagaggttgcagtgagctgagatcacatcactgcactccagcctgggcaacagagtgagactctgtctcaaaagaaaaaaaaaaagacctagggtctcataacaaaatatgagaatatctaggtttctaaagagaatttctagtcataccaaaacccagggaatctcaaactaaatgaaacagtcaataaatgctgacatctacatgaaagagatgttagaattacctgacaaagatcttaaagcagtcatcaaaaaagtgactcaacaagcaaatatgaacatgcttgaaacaaattgtaaaatagaaagtctaggcaaagaaagagaagatacagtacaaagaagaaccaaaggggaattttagagttgaaaattacagtaacaaaaatcagtggatgggcttaacagaatgaggacaaagggaagaatcagtgaataggaaaatgcatagaaatcacctggtcaaataacagagagaaaaatagactgaaaaaaataaaagaggaatccaggagactataatacaagacctaactttcatgtcattcaagtcccagagcaaaggagaaagaggattggctgaaaaaatactcgaagactggaaactccttgaatttggcaagagatgtaagcctgcaggttcaagaagcttcataaaccccaagcagaataaaaccagacaaatccatgccaaaacacatcataattaaatttctgaaacataaaaaaaagtcttgaaaacagcaagagacagctatcttggaagacagttcagatgacagtggatttgtcatcagaatcacagaggttagcaggcagtggtataatatttttcaagagctgaaagaaaagaactgtcaacccagacccttttacctagttaagtcatccttctcattcgcattctcagatgaagggaaactaagaaaatttgtcaccagcagacctatgctaaaagaatgcctgaagaatctgtccagacagaaagcaagtaataaatgaaagaaccatggaacatcagtaaggaagaaaaaatgcagcaagcaaaagtatggataaataaaaatagggttttgttatcccagagaaatgaagacatgttcacacaaaaacctgtgcacaaaaatttatagcagctttatttgtaatatccaaaaactggagagaaccagctgttctttatgaaatgaatggtgaaacacactctggaatagccacaccatgaaatactgctcagcagcaagtaggaacaaacttctttttttttgttgtttgagacagggtcttcctctgtccaataaggtggaatacagtgacacaatcatggctcactgcagcctcaacctcccaggctcagatgatccttccacctcagcctcccaagtcactgggaccacaggcaggtaccaccaaacctggctaatttttaaaaatttttatgtagagacaagatgtcactatgttgcccaggctggtctcctgggcgcaaatgatcattcctcctcagcctcccaaagtgctgggactacagtcctgagccactgtgcccggctggaagaaactattgatacaatcagaaacctgcatgaatccccagaattactctgaatgataaaagccagccccaaaaggttacatattatataattctaattgaaatgccaaaattatagaaatggataactgattagtggttgctagggattaaggggtgggagggaaatggatgtggctataaaagggcaactagtgattcttgtggtgatgggatattctgtatctccactgtatcagtgtcaaatcctggttgtgatactgtattacagttttgtaagatgttaccactgggggaaactaggcaaaaagttcagggatcttctgtattatttattacaactgcatatcaaactacaattatctcaaaatagaatttttcattttaaaaatatgatgataagattagaaacagacttgtgtcctgactatattgtttaattactagagattttgctatataaaaatattaagtactagagattttactatgtaaaaataatcttgcagtggtgggggatggggagttattcctccggaaaataagacactgagatgcctagagaaaaagatgatggatttgactagataaaaatgcaaaacgtttgcatgactaaaggccctatagacttcaaaagacaaaccacagaatggtttattattatttgggtttgtccactgtctcctcgatattagattcaggtcacgcatttttggcaggaatgctgcagacctacttccgtgccctccttgatgcaccacaccaggatgaatttggaagtttattccatcactgatgatgatatcagctttcactatttggtgaagtcaatattcatttgtagtgaaaattcactacaagacacacaaaatagaaaagaaatttaatacaaattcaaaaagcatttcatttagtaaaaacaaaaatgatctaatagaaaaatgagcaaagattacagatcatttaaaaaataacaggaagctgcgaatacgtgaaaataagctcaacatcactagtgatgagaccaatgcaaattcgagtacctgtgagttgccttttttgctcctaacacattggcaaaattatttttctccttaaaccttgtgtttgaaacaattccaaacttagagaaaagttaaagaatagtgcaaagaactcctatacctcatctccccagattcaccactgttcacatttttcttcctgtgttctcttttttttccctgtccctcccccactctctccacatgtatatgcaatttctctcttgaaccatttggcgatgttacttctattcaccatgcctccttgctcccaaatattaaatctttatcttccgtagacaaggacatgttcctacttagccatggtacatctgtcaagtactgaataggaaagttagcattgatacaatactgttatctaaccaaaattcatattccagttttgtcagctgtcccaatgttgtctttgacaataatttttttccatccaggatcacgctttgcatccaatcatcctgtcccagtggtctctttaaactgggacaccctccaccttcctctcctctagcattcacattttggaagggagatttccacttaggctgtagactgtgcctccatttgggtttttccactgtctcctcaggattagattcaggtcacgcatttttggcaggaatgctgcagacctacttccatgccctccttgacgcaccacaccaggatgaatgtggaagtttattccatcactgatgatgatatcaactttcactatttggtgaagtcagtattcactgggcttctcaattaaaaggttattatttttccttttgtaacaaaccaggacttttatgggcagatactttgagtctatgtgattccgtgttcctgcacaaactttcaccctcaaatttagcatctgctgatggttgttgtctgaatcagttattctaattgtcaaatgattatctttctaaattccacctacttttactagctgatgctttattatactataaggacaagcttttccttatctttttatttcatatcgttattggatgatgagctcatggagtcttattttattcaggggccataattcattcctatcattcattctgatgcccagaatgtcccagctgggccaatgggagcccctttgcttggttcctgtgccctgtaatatgctttccttgttctctgagtccttccttactttcagtgagatgttctaacctcattttttttctgctccagccctggaaacttttctccagggagccctggttccttttagtggagacagaatttagaaaccaagatgtgagtgctgggtgtgctcatcgttactctagaattcctgaaggcctggggatggagcgctctcattctcacttcggggagagagctgatgcaacagtttaaggggcatttggccatccttgtcaaacgtggccatgtgcccatctgcacacagacacaccatttgcaggaatctgttcgacaaagaggagcacacaagtgcataacaacaacccgtggaagcaaccagagtgtccatcaaggtcagctaaaaaaaaaaaaaaaacactgagctccctccctttctaaacgacactcagcgtacattgaaaataataagactgatttgttcaagttcaagaattactaaaggagaagaagcaactaatagagtggcacatgtaatctgatttttaaatacatttaaaataaaatgtgtgtgtgtgtgcgcgcgcatgtatcttatatacatgagtgtgtttgtataggaaatactctggaaggacgaagtccaagctcccaagtaatgttatcgctcagagagggtagtgagcagaggtatggaggctggtaatacaagcagaaaattatagtttttatttcataaacttctgaactatttgaagactttatagcagccatatagttcctctatctgtaatattttttaaaagtgttaaaagacaataggccaaaaacgacagccggctctctagcctacaaaactggccagcactgttgaaatatactaaagtagttttaaaaataaagagaaaggtactcaccagaagtgggatcaatcggccttggaagcagaggaagaagagaaggaagaggaaaccttggcagtgtttattgtacctgccctggagcagaggtggggccctggcccatcttggttctctgtgaagtggccctgcaggctcttggggacatccccaggctcttgggaacatccagctccccagctctgatcctacccaccactggcttcccctgagtggtccacagggggagaggatgtagtggcaccagccataggaccagaggtccctgacctgggctgtactgctcttcctcaacttctgatcatatagatggatccgcacgtggtcaggaggatggattctggagtcagactttctgaattcacaccctggctcaccgctcactgacttggaacttggaacatggcaatttcccccctacccaacctctctgtgcctctctgtgcctcagtttcaacatctgtaaaatgtccccatacagttgttggaaaggtcaaattagtaaatatgccaagtgcctaggacagtagctaggatgtagtagactctccaaaacgattgtttgtgatattattcctagaagtcacagtgggcacacccttctcttttttcagaatgtaacaggaatgaggccagggttttactcttaggtgtgatattcctgatcgtttgccatagtggtgtgtattcgctaggaatgctttcaactgcaacagttccaaacatagcagcttaaacaaataatgttttgttttgcctccatttacaagaggcctgccagtaggcagctgctggcctgggttcagcagttcaaccccgtcagagctttgtctatctttcatgcattctgcctcagggttgcaatatggttgccccagtgcctggcatcacatctatcttcaatgtaggaagaaaggaaatggaaagaaaagagctgcatttggctcttttgacaagaaaacaaaccttctcaaaatatcccagctgactgccacttaggtctcatttaccagaactgtgtcatttgaccacacttagttcaagagaggctgggaatatatttagacttttagcctcaatagtgcagatctcaagggaaaggcggttggaaacagcctcatggagcttgccactattttctttatcccattaagaagatccgtatggcccatgtttgagtgacatgtgtttgagtgaggaatggttggtggcatacaccaaatgttttctcagcagagggaccatcccagtgtctctatcccgctcctactctaggggtccaattaaatggagtcccacctattatgaagcagcagcaggggaaattcatctgtgggggcagctgggagctccaggacttagcaaacctgacagcctgtgcagaccaggatgcagggcttccaaccccagccacctccctgccgaaatggccaccactgccagctccaggttgctggaggaagctggaggctgccagtttgctagctccaggctttgacagcaagggcatctctggtcagtgcctcctggattgttcaacctgtttccatcttccaggctctcaggagcactgggcagtgcagtggggtgggggcttgggagctcccatgtgtgacagacacagctcccagcttcccttcacatccgcaatgcaggcctggctgatggtatctagttcctgagaccctgcagtgaactcagatcccagatactttcccttgataacagcttcacctttttcatctcttttaacaaataccaactcctggctgaaacccagactcctggctggataccaagtcctggctgaaaaccccttgctgcttcccagaaacagcctggtctgacatggtcagtggagaagagagtgggcctggtgcccacagccacttactgccttctctgggccccagttcctcctggtgaaatcgagagggtgggtaggatgcttcctggctgccccctctgtgcacaactggtggctgtgggtcctggttgcccctctgtgcacactctgtggttgtgagtcctggctgccccctctgtgcaagcccagtgggtgtgggttctagtcaccccctctgtgcacacccggtagctgtgggtcctggttgccctctccgtgcacaccccctgatgtgggtcctcattgcccctctgtgcacacctggtgactgtgggtcctggttccccactccgtgcacacctgatggccatgggtcctggttgccccactctgtgcacactcagtggtcacgtgtcctggttgccccattctgtgcacactcagtggtcatgggtcctggttgccccactctgtgcacacccagtggctgtgggtcctggttgccccactctgagcacacccagtggctgtgggtcctggttgccatctctgtgtacaacctgtgattgtgggtcctggttgccatctctgtgtacaacctgtgattgtgggtcctggttgcccctctgtgcacacccatcttgctcctcatctggatgaagtcactgcccatggtggcctcatgcagcctgtgatgctgggctctcacttgctccactttccagatgaggaaactgaggctcagaaaagctgtcccttgcctggatctgagcctggtcttgcagcccagagctcttgccacctggctgcacccctggcagtgaccaaaattgttggtcccgacccagacctcagagggtcagtgaagagtgtcctgggttggcttctcctcccctctgcaaatcctctcagcccacactctttcagcttctcacagaccacatgaaataatgtgatagatgcaatatgagattaggagctgaacctcacccaggtcaggaaattccaagcgcagtctcccagctcagctctggctcccgtatgctgcccccaggtcgcagcggggtgtgcaggggaccattgcaggctgcaggggcacctgcatcctctagaacttcctgaagaccagacgctctgattttccaaccagcaccagcccagtcatttccctctgcctccctggggactgtcccagccgccatcccttgctcctgcctccctggggactatccaagccaccatcccttgctcctgcctcatgcgggtttcctctctagccagatcctccccgtctgtatccaaaaatactgttacttccctgtccttaagacagtgtgtttgactgctttgcttgtttgtttgctcctcttgatggtaaaactgctccagagatgtggccccatctggggttgccccactgaagccctccacagagactttgtgacacctgaccactaacctcacctcgctaaactgaggcagagcttggcaacagtggtgactcagtggctcagccctcctcttgaaacaccatcctcccgagttccaggacccctctgccaggcccctccctccttctccatcccccacacctccccccatcttcccgtggggggacccagtgctcgtctctattcacactctacagactccgcgtgacaccaggccccacctctgcaccctccacctcaaggatggatacaccttccgggctgtacccgtgaaccccagcctccaggtctacccaaaacctgctcaccatcaccttctcaggtacaaaaacagccctcttccctcacacccccaccgcccaacctgtggtctaccttggaaataaacctcacacctctggtcatctctactgccaccccactccccacccaaaccactcaacagccacctggacctgggaacatggcagctgctggaggtcttaaaggcgccctttccctaaggtaagctgaagcccagatgccagcacagccccttctcctctctgccctggtccccacctcctctcaccccctcactgtactccagtgccctggtctcctgagcaccctcaaacacatgtccccaaatccaattccgcccccaggtcccatgattccctctcttccttctacaactcatttctcaaataactcctgccctgctatcccatcttaaaccgcacccaccctggtgttggttagccagtgctgaggaacaaatcagcccaaaccttaggggcttctgagaacattacagtcttagcttctgcgggtcaggagcctgggcatggctcactgccacgtcccccacccccagcccagggtctcccataggctgcactcagggtccactggatcgggtcatctcagggccgggtccacctcaggctcccttacaaggcaggaatgggctccctctcaaattgtagcaagggctgccccaagtccctggcacacggtcccccagagcgctgctgaggacatcgaagcaagcaaggcaagagagggagcaggcaccagtgagacaacccacaggcctctgtcagacgggggccttgggggtggcagccatcccttctgccttttccatccattagaagtaagtcctggcccaagcagcctctggggaagggcagctcaagagtatggccccagcagtgggcgtgaagctctcctccccactgcgagcttctcactccccacgtaggcggctccagtgcccagctctttgtctgtctccttcaaggagaatgcaggctcttgagggcagggcactccctgtcgtcccaagcttcatccccaccacctgccctgtcacagcatcagcacagctcacagcaggtgctgaataaacactcgtgaacttcagaaagcccctcacagcacaggaggagaaatggccatcctccccagagacttcgctggcattttcctatgttacagcctgatcctaggacccactgaaggctggtttctgcaggagtgaggaagcctgggtgtgagcccctgaagctggggccatactggttatctcggcccagcggcctggaaatcacaccctccccagacttgtccccacatctgagaggagagacacatcgcagagcctggcctcgaggtctcaggggtcccataagggggtggggctaggttcattcttttacatatgttttcaaatattgctaaaagtcataaattgggccaggcatagtggctcaggcttatggtcccagcactctgggaggctcaggtgagaggatctcgagtccaggaattcgaggctacagtgagctgtgattgcaccactgtgctccagcttaggtgacacagaccctgtctctttaaaaaatcataaattgttagacatacttttggggaagtcgtttggtacacactccttgaccagtatgtccagatcctggaattactgatttttttctatagtcacacatgaatgcagagatgtgcagtgcagctttgtctataggagcaaacaaatagaaaagctagatgtcctcgagtaggagtggatgaattattacagcacagccccacggtggaacactgcacagccactggagtcccaggcagagccgcatctgggtgcatcaccatctacctctttatgtaaccagcagacagctatagggcctgcaccttccgagcactggaggcagggaaccgcatcgctgccttcaggaactttatgtcagggttaatgccaacatgcaaataagaatgcaaacacacagacaaatgcagctatcacaggggtgtaaggaaggcagagcaggacagggagattgggaacatgtttcacacagcaatccgggtggctgcgcagatgccagggcacagtgagggagaggctgcagcaagctggggccggcccctcccaggcaggaggaatggccaggcagggcaggtgggggtgagccagggtgaggaggatcctgtggcacctggcagccacactggcattccatactgatctgtgttacaacacaggcacccacctatcagagcagcctgggccactcgttgccagctgcagacaagggtcaggctaactggtgctgataagacaccagcccccatgcacctggtgtgatagggcgttgctgcctgccagtgtcactctggagcagatcagcaggggtgagggcaagggcaggggccgggaggaggctgcatgacccagggtggggaggccgacctagagaagcagagtggggcaggtcggggagacagatattctgaggggcccaggacctccacgttctgagacgctccgcacacagcttctggaaatgttatgtggaatgaaccatcatctggtctttcccttcttttttttttttttttttttgagttggagcctcgctctgtcacccaggctagagtgtagtggcatgatcttggctcagtggaacctccacctcccaggttcaagcaattctcctgcctcagcctcctgagtagctaggattacaggtgtgtgccaccacacccagctaatttttgtatttttagtagagacagggtttcaccttgttggccaggctggtctggaactcaacctcaggtgatccacctgcctcggcctcccagagtgctgggattaccggagtgagccaccatgcctggcctttttctttcatagacctttgagattgccgaagtcccttccaagactcaaatctactggctcggatacaggacatgggcatttggagtagacctccacccagacacaggaaagtagccccccatctccgtcctcactggggtccacttggcaacccagcccagcacttggacacggatggcctactctgccccagtgcagacagctccaggtaccaggtgctcctgagccctggccacaggtcagaccccattctgagaatggtcagaatccagagagaggcctcaggtcctgtgaccccgaggtgctgaccaaggacctcgcatgtgtctggcagcatgctgggcctcacaggaggaaagggggccctgggcccttcatgtacattgctgcaaggtgggcgctgtcatgtgacggggagtgtggaggcctcgggtggcccacaataggcagtgggaggacaaggccagggcccagcgcctgcaattctccatcacaccctgtgtgctgagcagccatccttcaccctcaggctcctcctcgtgggggcacaggggaccctggctcggggagtccatcacttgcacaggtgtcacaggcatagaagtccaaactcaatggatgcccttgcctccagctcccagctgaacatcctggctgaaaggggctgaccgccctgactttcctctgaggtaggtgagctctgggggctccatgagggaggtggctgtgtccaggccacacatccctctccaccaaagcgtctgccctgatgacatcacctcacaccgccaagccattactcacagaattacggcttgtctggaagttggatgagatgtatacaatgcaccaggatgacaaatcctccctttgagtgggtcatttcccgaaggagattccaaggattcacagatcagcgtatcctggcattgcaggcagtggaagccgaggcccctgagatgtgtctgggtctagtctcgctgtgctaatgaggccccagggccagagtggacactgacgtccctgtggggcagtgccacatgatcacatccatgtagtgaagaggcattctggactttgtccctaactcctggtggtgaaccatctttggaacctgatccctgggcccagactccctggtgggtctgacctctagcccacagcacagcaggttgcagatctcattgtccagaaacagccacagcaatatttctgtgttcctccaggatctggccaccactcattgagaggcagagtctatttctcctctccttgaaaccaggggtgccttcacaactgctgagatgaagaggagagagggttttaggtgacttccgatgatgggtcacagacagtaacgtgactctggccaccacattgtaaggaagcccagcggtcccggcccacagctccagcaagggagctgttagtcaaccgacagtcaacaacagccaccagccaccagttgcatgaggggagctcagtgttgccagccccagcccgcaagccgcctgccctaaatgagacagagctgagcagagacaagctactgcacggagcgctgcccggattgcagactcaggagcaaggcaaatgatggtgttgctttaggacactcagcttgggggtggcttctcattcagcgctagacagggagaacacaccctaggtgattccccggccttccctgggacttctgtgtctgcagatccctggtgcagatcccaggcaggcagagggccagagcccatctgcagtgatggttctgcatactgggcgggctccgatgggtcgagaacagctccttgggcctgggggcaggactcagagccacattcacggctgcaggagtcatggatccgtggccaccagggtctgtgacagggaaagcgctacaggctggaagccctgtctggggttatctatttaatgggagataaagttttcatagtactaaaaagtattagtcttcagaattagatatttgctcatttttccaaaggctgtgaggtctctgaatccctcctgcagatctgtggcaagctgtgcactgtcctgtagagaaatggccctttctagatctccactctaaaagcagcaataacaggacgatgcgagagcagagcctggccccaagcagcgtgggtccccaggcattaaggatcctctgcaatgggtttcattagatgagttgtctttggttttattaaaatatgtatgccctttttattaaggcagtattgacctgtgaccatgtgggaggacaagcccatgccccagtctctggctggagggtgttgccccctgggcctccacaggcttcctgatcaaccaccctgccatccatgggcacagaaaacatcaccaggacagcaacagggggaaggcagagtgcagctcccaccacgccgtggtccttggggtcctcagttggagatgagggctgcagctccccacctaggtcacagcccatgcccctctatcccagcaaccactggaccagcctctaccaaggccaccaccaagacagcaccaggccaccttcccaccagtcagcagcttcctctcaacctctattcgttagtaaataaattctgattcatgaagccataacaaaacaaactaaacaacaaaaaaacctatctaagacaccaacatccctgaaaaacaaacaaaccaaacaaacaaacaaaaaacaaatggtgctctgcattccctaaagtgaattcctttgcaatgtacatgagttgctggggctgctgtaaggaagggccatagactaggtggttaagtttactgccccccagttccagggctggaagtctgggatcaaggcctccaagggccacccgcccccttagggtgctagggaagggtctattccagcctctccttactcatagacagctgtgtctccccacgtctctcctcatggtctcccctctgtgtgtctattggtgtccaaatttcccttttataaggataccagtcatactggatcagggcccaccctaacgacctcatctgaccttgattacctctttaataaccttagctccaaatacagtcgcattttaaggtcctggggcttagcactccagcatgggaagtggggcctgtcctgagtcagcccagggtgggcagtgggtatgggagttgcccaggctgctcagagcagggcacacaaaggaggcagcagcaaagaagcactgggaagggctggttctcccatcatcagggacaaaggactgagccccccaacaccagctagccctgcggggattttgctgggagctgtaagaccagggtccagcagaagcagagggcacacgaagggggcagggactggggtttcctgtaggggcagaggtgtgggcagtatggggaacccccaggcctggagagaggctgacccagcaggagctcaggggatggtactggacctccaaacctggctgagaaagagggacttgggtgtgggggtgggggtcaccggggccttgccaggagggggcaggggataaacacactgtcctccccttgctggtctcccccagggcctccaggtggagggacgggtggcacagttcaaccgcccccacccctccgccatcccccttctgccccatgtggtgtatgcacaggatggggcagagctgagcaagcacagctcctaaagaggagggcaggaaacttgctgctcttacagccctgcagccgcggggaggcttgatgctcccagcaggggaaagcagagaggcagctcaggcatggccagcaagggcttagacttacaactccttgagggcatcagcagcacctagactggggatggcagagtgaacagtggctcaggcgagcttccccgaagtggggagtgcgggcccatcattctcacagagccacagtggtggtggatcacacaaaggggagaccatgaggagagacatggggaggggacagctgtctacaagcaaagagaggctggaacacactcttccctagcaccttcagtaggtgggcagccctcagaggccttgatcccggactatcaatgccatgagcatctccaagcccaggccccgggagggggccccactgcatgggcctcagacagcttctgaccagccagccccaccctgccccacccttacctgccctctccttccctggagaagcttgatgagaggggccctgggccaggcctctggaaatccttctgctgcaggcctagagctcaccagggtggaagagggaggggatgggatagcccagatgggcccctgctcccagcagcctccccaccccctgaacactcccctccaccccacctagccgggcaggcccagctggccccatttctcattactattgattatggtggcagagacctgcagcacagaatgtaaatcagcatccctggggtatttaacctaggaagggttaggtggaggtggcatcccttataagtcctgcatctgatgtttttatattaattcctatagtggccagattaatttttattccactgactattatctcttcttcattgactaggagacatttctgagaagtgcatatgtgttgagtatcagtcatttagtggggggcttccctggctgcaaggttttcattaaagaaggaaaattcctttgctccaaagactcagtctggaaataatgcgcaggccagctggtgtcactgccagtgctgccgtcacctgggagtggggtctgcagctgcctgggagcctcaactaaaggggcagggccccctagccgtccctcatcctccctctcctcccagcctcccaggcccagctttggcctcacacaggctctgagtgagccttcagcaagtgaccacccccagctcctcagcccttgctctgtgctggggcctcccctcccacatctcacagaatccgtgccccgactcggagtgaggtgggactgtcactgcagccattttgcaggtgaaggcaatgcacttgctatagattccctgacactcagtactgtacagggtcatggattatcttgggtgggatccaggcctagatcacagaaatgaccaccctttttgatggggtggcagaggcactggatgggtggcttccaagggctccgggccttgcatgaggagtccagctgaaaaaacgggtgtcagaaggccgagagctgtctgcaaacccaagtctctgcagagtgtggtgtggtgtgttctaggagcgtccttccccgctgaccagtaaggccagggccaggggcataagtccagggcactgaggctgggaacagagaggaacatggggaggaggatggaaggggggctcggcagctccggggatgcctggccaagctggacatgctgccagtaggtgggggagtgcctccactctgagaccctcacctgtccctctcccatcctacagggttgagaggagtggatcccaagtgtaggcccaaatgtggagccagcagcaacccagccactgggagctcatggcaagtgtacaccccggcccacaccccacatcccaccctggggcctggtgaccagcctccactggcgcttgggaaccatgagcagggtggctcaagggccccagagaagaaacacctgagctggagcctcagttagctcacctgtaagatagggatgttgctgccacctggggatgctgtgagctgagtgaattggaggggccagtcctgggctgcctacttgcccacatggtagggaggatctccaccagctgttctcaccccccaaaaaagagggctgcctctttgtccagaagagatgattcagggaccaaagctttacctccctgagggatctcattcagcctttcttccaggggccagacatgcataactaaaacccaaacctttatgatttggagaacgctgataaattacaaatgcaaatgggtaaccaggcaacagccccccccgcctgatgccaggctgggtatcagggctgggaaatagagcagaggtcacttcctcccacctggcacaggtcacgagagcctcaatgatgtgtcctttacaaagctgcttttatttagttggaagctgcttcagagacaactgtgaagacaaaaaaggttgctgtgtgtggtggctaagacatcagctgcatctgaggggctggattctgcaaggaaataaactatgaggcaagagaaaggctttagaagatcctccaactgttctcatcgttctgttagctggtctcctgatgaggttctgggtgagtctcaggggctgaggaggtgagttcaggcccctaggagaagaaggaggggggaaacatttcccttcccagtgtgggcctttctacacctacccctcatttacagcctgggatgaatccaccagggcggctgttcacacacaaccctgtcctgaccccgtcccaaccccgtgcgcaccacctcccacccaggagggtgcctaggtccccatgagtgcagggctgggtgggtgagggtttgaggcaggccctgagggccaggcccagggaggcaggatacccacagaggtggaaaccttaggctgactttatcttggctccagtgccggagctgttgaaaacgtggccccaaatgtgcacagaagtcagcagggtgaagggtgagctgccttgcctgctctgccatcaacatggaggcctggaagctttttgcagccctcaggaggggtcctggaaaacagtgcagacacccgtcccgccgggcctggaaaacaagcgagcaatcagctcagcctggccctagaaccacccacccaaactggccccaagccacagcacggacgatctggtgtgtagtgcttagatgccagcctcactcgaagatgagttgcaactggggctgcaattccaggagggcacccacaccttcacagctcagccccatcttgggctgagactagagcaactcaggcaggatggagccagccccaccagcggctgcttggtatccaggcctaaactgggcaaagggcggctgcaggaccctgggcagggcccaggacggatgggtgggcaggagggtgggggcccatctctaagccggaaggagaagcttccagacatgattgcatctgaccttctcctagcgtctcctctctctggctcagggcccactgtgagctcagctccgcactcctgggtttcatcctggggaactttgtaaagtatccaatctacagaaaattgccaacctctggaagcctcagcaggaccaatgtcctccatgcagagcccttcttatcccctaggaccgcaggcccaggctcctctgggggtcagggcggggcacagctaggagggaaggggagttgctctgggtaagtaagatgcttctaagcttctaaatcaggttccagagagacccccacccctgatcccccaccccctgctggcctggagcactgaggtcttccaaaccttccagaacattctcagctgagcactcccagccctgggcaaatcccaagggaacctggaaaaggaagcccctccccttgctgggattatcgtacccttatgcttaaagggccagagggagaagaatgtttctgtgctttttagagaaactctctccacaaaacacttcctgatgcttgtctgacaccaaaaatctattaaagtcataaagttctcctgcagaacgcttctcaaaaatgtatttatctaaagggcatctgtgtttggtctccaacgcaaacgctccaaatgtcgggccccgggtgatttatttgggcgccttgttctctccctgcgagttgttttcagctcaagcccctggttgcgtcgctccttcccctgatgtttatagatggcttccatccgctcagagccaggccggccaggaagaaggggcttggaggagcaggtgagcgtgcatcaaggggctgcagagagtggggcagcggacagatgctcccagcagacccctgcactccccacctgctggctgagcacactcctggctgtcctccctgcccagagggcattctcctggcagacatttgaacagcagctaggaatcctcaccaggtccccagctgccctagatgctgggagttcagcagtcaacgcacctgaacccacgcaggcagacggggaacatgagacagaccaggaacagacaacaatgaagagtgatgcagggagtctggggccacagacattgcaaggccttcctcaggccacagggaaatgcagcacagctagggcgctaggctccatgcagcgccagtgccaagcatctaagcagggtgggaagaggtgacttctgagtgatgagtaggagttggacaacagaggggctgggaggagccaggaagatcctcccaggcaggtgggggtccaggacagggaacacctgggagtctgagggatggggagtctggggcagaggagagagggctggatgctgaggtcccagcattagtgatcaggcctgggcctctggctgcatacagagtcccctgacagctcttcatcagcctcttaatacgcagtagctcatcagcccctttccaaagaggcccctgagggcagggctctgccaaggctgagctgtgtctgtgctcctagccatgcctgctgtaggaaggaagtcctggggctgggcctggagggaagcagaagactctccagatagggggtgcccagggtgtacccctgcagtgccgcccgtctcctcagggctgtgcattttcaagctgcctggaagccagggcccagagggaatgctgcaagagcagagttccctggaacaattcaaccggctgcttctctgctctccttccagcagggaggtgggtggcaggagcccatcttccccaggcacccccaaggagaggctacggagatgttttttagagctgcattgctcaataagtatcctggccacatgtgaatatttaattttacattatcttaaattcaataaaattaaacattcagttcctcagtcacactagccacattttaagtgctcaggcagcacaaagttcaacatggtcatcgtcgcagaaccttcccctggacagacagagcaagcagggaggggcctctctggtttgtatgaggggtccaggcatggcgggaagccctgggcaggcctcagctcaggtagcagcacagggtagtgcaggggctggaggggaagtcctgagggctctgcctgcaaccagccccagggcttccaaagcaacaaaggcctgcgggagagccggaaggggtaccaagtgcctgggcccagtgcagtacctgagcaagtaccaagtgcctggaccctctgtagacacaggggctggaaaccacgcacgacctgcaccctgcaccccacacccaagggcaagcaggagggaggaaaggaaggtggccggcaggcagcttacagttccctcctgtccctgcagctcacagcagctcccgagtgtggagcaaggcaggctcccctgtgcacccacaggcctggagggccctggcagatacacaccttgccagagccacagccacctccatcctgggcccatggcagcctgcagacaccactggggcattcagtcactggcttcctgtttgtcagcatcccaaagcaccacagggttttttggctccaaaagacctcctgggccaaagtgagcctctgaaggtcctgcgggcaggacacctctcagaggacggagggcgcactgcaacttccagggaggccagccagaggctgctgagaggatgctctccgggaagggtgaatgcctgcctgttcctgctggggcactgcggggaagccaaggttggctggcctcccaccacctcccggtgtctccagggcagcactgtcccccagcaccatcttctttgcccaaggtcagctcccggggccgcccaggcctgacaaccatcacctacatctcttctgccttggacccctgcacacatgccttgagtttgggagactgtcccctagatgtacggggaatggagggacttggttttctccactgcaacgtctctgtttccaaaaatggtgcctggaatatagcaagggcccaggagatatctgtcaaataaataagtgggcttttcaagaaggacgaagggcaattgtgcagactgggggaaagagagattctcctaccagtgttggagcaaaaaacaaatcctcagtggtcattttgggtttggcgactgaagaggagaaatgctgagaacactgggagcaggcgggggcacacttcctccctggaaccccgctgaatggcagctcatggtggccttggatgccagggttcctccttcgaagtggctcctctgtggcccttctgtagcccctccagctcagacctggttgtagttgagaagcccaaggagaagttgtaaataggttttgcaatggcaatggtgagcttaatttttcattgaccttacctccagctaataacgaatcggggggcgctctttcactcacagaagcaaaaaggaaaagaaagggcttcctagtgacgagataatttgtcagaaagttatgagtgggcacggcagggctgtataggaagtgtgtattgaacaatacgacacactggcttctaattgctgctgcctttctgatcaataatacatgttttcaaaaagccttctgcttgcatttacacaatggactgtaactactgcaaagatccattaaggcctattttaaaaagcgcattcgtaaaaagttgtctaaatctgcattacaaggcagattatgaaactgccttgggagatgttttgtctaaaaagcattcagcctgtatctgctggacagctgactcgagcttccactctccacgttgcttggagccaggatgccttctccagaggatgcaccaagcaaggcaccggcaggcctgaggtcctgtccacagaccagccggcctctgagcccctcgggctggggctgccttatgtgagccaatcccccaggagcctgggtggccgcagacattaatcaacccaccactcccgaatgtgtaattcaaggtcagataagtggtcctctgcggcaaataggactctggggacccaggtccctccagcactgagaaggcttctggttgcatggggagggctcaaagcctgtggccaagccaggatgcagaagacaggtgtgtgctctagcaagccagtctcgttgaccaccagccccacacagcacacaggtgcgtgctgtcacctgtgcaggtgggaagcccggactgtttgggtccagggccccctggctttctatgccaccctagcaccatccagtgactgcttgggcctcatggcctcagctcctacagctgacaggacagaggctgatgacagcggcagctcgtgctgatggccagcgtccctgggctaaggactctgtgcagactgactgtctgcatccccggggaacttggggagaaggagctctgccttcccactgaggcacggagactctgggtaacccgccaaggacatggggacaagagacagagcgcagacacactcagagccccctgcagccttcccaccatgctactgccccaggccacacctagacagccccctgtaggagagaaaaccctggcagaggggcaggaaacactgccactgtctgctgagcccactgatgcatcattgggctttaccctcaaggcagtgcccatgttattgctctcatgtcacagaggatgacaccgaggcccagagaggaccacagaagctgctgagtggtgtggctagcctggctctggtgctgagcgaaaaggatggagattcctccaagggaaggggaggagaagacgggcagaggggaaagaagaaaggagggcgagggaaggaaattcacaagagaacaaagtgtggggacatggaaaactgaagtgggcaaagtgataatgataggttagtgggagtaggtgggcaggctggtgggaggaggtgggctttctctgaaccccccagggtctctgatggatatgtaggcccctgttgcttttgttcgggcacccggctcctaatcaggccccagggaggatgcaaaaggggtcttctcccaggccaggttgagggctcttctgcaaacacccctgagggcacctgaggcccacaggcaggcaggacctgcacagttaggtaaagcctgtcctgcacagccacaccctgcaggcccaggccaggtgttctgtgagcatgctcatggaagcagcatatttggcatagggtgggctggctgagcagcccctctgagtgccctgagagctagctggtggtcactggcttcctcctcgcagctgccctggagggcaccaacagcaaggccagggaggcaaaccgtggggagcagtagacctgcccctcacctcaatagcccgatgggggagcagagggcagtggcagacagatgggaaactgaggcaccgaccactttgctaacagtgcacacagccagcctcagagtctgtgcttccaaccaccatgtcacactgcccatgggagggacctggacccctgcccacgcccactctgagaggcctcggtcagcagttccaggaatgccacccagccttccagtatcaccaggaccgagctgcgctcttgaatgtgtttccccctacctgcaagtcacgaggcacccccagagccagagtttcctgtcactgcactcagcctcactccaaccatgcttctcagtgcaggcagagacccccatgtcacctgggtcagaggacacagagcatcccgcccgcctcccgccaggcaaacctgcacaggcatggcccagatctctgtccatgatgggtttccctcctccctcccttccctgtgctgcgttttggtgctttggggtcagacctgaggtgctccaggtaatcttcacctgctcagaagcaatgaatgacctccaagttctcacatgctacaggaagatggtgtgagccgcctgcccactgagcatcttaccctgcactggggcagagccttgaaaataccatctcctcacagtcaccagggaaggacactgtttcagtccccatttgagagatgacaaaactgaagctgaggagtaatgtatgcaatgtcacacaactatgaatggcaaaattcaaactcaggtctaatcactccaagcagatgcctgcaccagaacctcttggggaatttttttttttttcttagagatagcgtctcactgtgctgcccaggctggtctcgaactcctggcctcaagtgatcttcttgccttggcctcccaaagtactgggattacaggtgtgagcccttagcctggcccctgaactttttttttaacatggatttttagggagtgggggacccaggatgtgtgtcttcataaaagctgccctgaagattctccaaggggacctgcgggcagggacaggaagcactgaccacactgtgatgtgccctcctccagctcccagagagcccgcgaccctcagcagggcagtgtggccagggtgcccgagcccaggcccaggaaggcccaatggctacaacttattaagggcttcctgtttgtcgggcactgggctctaccctcacatgcacccctctttctagtttcaccccttcttctgaaagggagatgtttatagctggggaaactgaggctcagagagatgactaaggggagtcaagaaagagaggcagagccccctgcaggccctccccaccccatggactgagagaagccagggccaggactcctgggcagccaaagaccggcacgtctgctttgcacttcacctggcccccacctccccttgtgagacctcagggggtggcctcgcttcccctctgctgggcaaggagctccttcctgctgcctgatgttctggatactgagcctacacccaggcagggctgaatctcctttccccgcagtccctgaggccagcaggctctgggcctcacaactgtcctctgctgagcgaccctttggtcagatccctgggcgtgcacgtagcagggaggtatgcatctgtgtgcgtgtgtgtccacgtatgggaacacaggtgtatgcatgtatgcatgtgtacagggtacacccatgtgagggccccccagacctttttccaaggagtaaatgacaccctctcatagtgtcaggtgttcactcaggacccccaagggtgagggtggagcgagagcgtggaaaggcctaaggtaggctaggcaggagcacagccccagatggccccttaagatggccacacagagcccagccagacatcaatgtcagccaagggctggccagggtggtccccgggaggtgcaggggtggggctatttaagcctacccacttctctcttcattcacctaggaggcaatcacaggagcttgtctgtagccaaaagatgcccccagcccctccctacctatcaggtcccttccctgggcacaggcctgagtgtgtagcctaggtagccactggcaccagagatggaacctgtctgaacccaagggagccccttgtggccaactctagctccataaactggaagggtgtggcaggcagccggagtccagtggcccacagtgtctctcctgggctggcaggcctgtgccccggccacctgcccctcagcaagccaggtctggacatcacggttggctgagtgcaagccagcctctgtcttggcagctccccctcctgcctgtgagggtgacttcactttgacttcatatctgcagtgatgtgcagatcacttattcagccctgagctcagccaggcaagagggcggggttctgcacacagcaagcaagggagcggctggctcaagggtgccctgggcccaggttccctggcttttcctcctcaagggcccatgggcttcccttcttccatccctctgcgcctaagtgcaggccagacctcaaaaagcagccggggatggggcgagaacagaggacttccccactgagcccacatccaacctcacccagaaccccttctcaggtccagttgctgctccctattaggggtaaatgtgtttatgcgcatcatttccatcatttctttgggggaaaattggattctttcctcctcctcgctactcgctctccgactctgccagcccatctcctgagagttctcctgtgtaagggatgcaagggccaccagcaccaggtctctgaaaggacgccggagccagtttccggtttccaagggttggaccagtgctggaggggggaatcacaaactgcccttccaggaccctaccctctctactaccccaggatgctgaaaaaggctattctgcctctcttcccctgctcagctcttccccgcctcctgcctccggccccagcagaggccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtgtaaactttttttctttttaacattctagttggaaacaacagatttctgattttgtagtttccatacaatatttaaaacatcacaaagaattctatcatgataaccactgaggcatcaatagtggtcgaggactaggggctctggagatatcgctggcttatctggtacatttgcgtgtgaataggcacattgatagaaactgaaaaactcagctaactccactgttcaaggaatcccttccttaaaagtgtccatccctagaacaaagcagcagccagtgtcaagtttaggtcttcacagttctctagcaatttgcttgttgctgatcttttgaagttggccttagagctgtgggagacagaatacaaaatgccaagtcctgaggaaggccattagaagtgtgagggaaaatgctgtcctgaaccaccatgaagcctgacatactcactacttctgtttatgtcttccccgaggaattctctgagcttctcatgccgggcgtggagctgatgggtcagtgggcaaacgggagttgttgtcaacatcagtctcatctgcgattgcattgtgtcagatgccaacggcctgtgtcacacacatacacgtgtgtatacgtgggcctttgcacgcctcgccaggtggtgtacatgcaggccttggcacgcctcgcccagtgcccgccccaggcccatgaggccccgcttcccagccgtgggtgtctgtgtctgctcacggcttcctccttcagcctggaccacgggctggaagtgaacgtaatctccagagccagctgtttgctgtagcctttacctctgaaagtagaaatctacgccaagaaaagttaatgctaaaagccacccctaatgtagactctacattaggactatttgtgtgtgtatgtttgctgttttattttcccctaaaaacacattttctgccaaccttcacgaaggatttcttcccaccacgaggccagcttatgtgggcagaaatctagttgaatgtgcctgagaacagggcttgaacaaatacttcatacacaaaagaaattttgaagggaaagcataatttctaacatataaagaaagcctctcccgcaggcaggtggagcagttagcggtgcctctctctgcctcgggtgcgttcacgcatagtgtctggcacaccttgttttattgctctttgctttattgcgtttttcacaaattgaagttttgtggcaacgctgagtcgtcgagaaagtctatcagggccattcttccaacagcccacactcacttcatgtctctctatcagtactgttaagcagtaaagaatctttaaaccaaggtatgtacattgttttttagacatagttctgtcacacacttaacagactccagtacagtgtaaagtgtaacttttatatgcactgggaaaccaagagacttgtgtggctcacttatttgggatcttcaatcttctttgctttaccggagtggtctggaacagtatctctgaggttcgcctgtgtttagtggtcctcacaactggggggtggttctaggaagtcctagggaatcctaacctctgtggccctgaaaaagcagaaaggtgggtcttcagggtgcatgcagcagtgtgcgtggccccacacgtcttccacatgaagatgctccaggtgcaagtcctaggcttgtgcgcctgcagggaaagcaccctctctgccagggctcctgctgtggccctgtcccttctccatggcagcagccttgaccgaaactgtgtagagtctcccacctcttcagggagctgggactcaggaaggatcatcttagctgaggtcataagaacctgcatgtagagaacttttcagcgtggggccactactgtgtcctgctgctgaggccaggtagtggccgtctgagggctgcaagggcaggctgctcccaggagttaaggaggcaaacactctgaacaccctggagaaatcacagtttatctttgcaactacaaatttgagtgctgtgtcaagtgaccaggtatttttgcagatgtctctgaggtgttaaatcacaggacctggccaagcaagatctctcagctggaccccgggcaggggatcctttatgggggcacatctcactgtgggggctgcagaaatgtgaaggtcatcatggagggagcttgcggtctgaaactaccccagccactgtgactaccacactgggagagatcatagacctgcatcctctcagatgacactgagcagttcaagctaaaaatgtgctggtaagcaaggtaagtgaattctaaagctaaaaaaaatcatttttcattttctgagaaggaaacaagtttgatatttcatacacagacaatatttaccatgcagactgtcaatttcttgaataaaaatatgaaattcatttaaaacattcaagtttttgtgtatttttctcaatgtattaacagaagagcaacctgtttcttggctgctcgattgtctcacctgcacatcaatccttttctatactctcccatggaagaaggggtctccaggggcaagagactttggtcagaggactgcagggagccaggcagcacccatgtcttggagcctcccctctccctagggcgtgtgccttgctccatattttgtgcctttcttctgggagttttcaagagcttgagaattttcctggagactctggccacagggcctgaagctcttagattgctcagaaccccatggtaaaggagcacactgagggtttgggggacttcagtgtctgggaagaaaagtaagatcatagcaaatgatttctaaaaataagaatgacaccaaggatggaagagctgtagtgtctcacaagacagtcactggaaaaagtagaggaagtgtggttggacactatttttaaagagatattcacacaattacctctaatctttaactttgtagaaataagcaaaggctacccatatgagaacccacaggagccactggttctgaacttgctatagcaagagagtcagccaggatcacttacttttggcagacactcaaaagcaggcagaggagtgggaaagccttatagtaaaaaataaaaggtggggagggtgaggagaagccttcagggatgctgtgattggggcttgttggcctggggaagctggaggcagctaaccaggaggagggcctcttatgtgattggtttgggggacacaggtggctttctctgtttagttcagtgggcaaaaaatagggaagcttgcagttcctgaccaagtcctaaccattctgggataattgttacagaggctgtggtttggcttcctggctagttctgcagagaatctgattcaaatcctctggccgtatgtggtctggccattgtctgtttgcatgttcagtctcttagtcccccttgtcggtcattttcttgtttgtaaaaggttggccaactcaaggaagtctagagatccagctcttcactgctcagagattattcagttgtctctctggtcaaccgtattgtgagatcttgatccttctgttgttatagcatcacagtgctcatttgacaagaatgggatgcagtggaacaacatcaggaccactatgacagaaacaagagcaactgtccctgtgagacgctttgaacgcaaacctcagctgaccaatgcaggccaagagcaaatcccatataggccatgaggatcaaccttagaaagccaaatagcttttgcctcaaggtgatgtgtgacctgttctaccttctcttgtttcactgatccagatgcagtattagcagtggcagaggccatcaccaaccaacaagaaatctacagcaatgagactgtccatcactactcatgccaatgagttgagactgataggtgccccatctagggaagaaggggcattgctaatgacttctgccagggttaatgataagtttatgacaacaggattcccacagatgagaacattgctctgattgtttgcataaacaatgagtcagtaactccccagttagagtgctgaataaccaagggtgatgttacggtttttgcagttttacaccaaccggtttgtggtaaatcgttacagcaaccctaggaaaaccaacgcaccatttctatgtatggttaatgcatggcaggtgtttaaaggtattgcaggatattggtgcttttcctttccccagtgcacctcattgatctcaagtgagggatttttctttttgtcttgatttttgttttctaagttgaacaatctttttttctcagtgtcctttctgtatacagtatctataagtgcccttgtcagtagctgactggttggggaggggctacccagctgtttgatcagcagggccacaagttaattttaggtcctgtcttatttttgttctaaagcacttttaaaatgtctgccaggtgttgtagttcaggttaaggggctatttcccattctcatttctgtttttgattaggtctccgatttcagatttagctccttgacaacaagcaatgaaagggccactttctagactcccaaatgatacaatgtattttctagcctatcccaaaaaaaactcctgcaggtccttttgtttgtttgtttgtttttgcatgacaagggattatggtctaatctttttggtggggggaatgtttgagatatggcttttagaagactttgccctatgttttgagcctctttgttaactcttcagttttattgtggacagtgggatcctaggatcccttttgggggagtctagtcaacttttgccattcaggatttagcatgcaaggttctggtcaatgtgtacaagttgatatgggttaggtaacactgggtcacatgcttccccccgccgctttgcgatagggtcttgctctgccaccaaggctagagtgcccgtggtgcaatcatggctcactgcagcctcaacctcctgggcgcaagtgatcctcccatctagcctcttgagtagctaggactacaggcacacaccaccatgcctgggtttttttttccatagagatggagatctcactatgttgctcatgctggtctaacttgtaggctcaggcagtcctcactgattcaccttccaaaatgatgggattacaggtgtgagccatagtgcctgaccaaagtattcttaattattttatgcatagttgctgatcttgcctgggtttggggaaatccttaattatggttattaatttagcttgggtctaaggtttaaattccacagttgtctgtatatggggctcatggaggaataggccttcagagaggcagctggcatcctggggtcataggagggttgttgtgaaagggcagggatctggacaagaggaagagaagtgtggacagatgtgtggaagggaagagatcagaaggataagggggagaagagggagagctgtattagggaagcaaatggatgataagcagaaggatttactaggaaaatgagtctaggttgttgctgcttaagtttgccaaatcgctcatcagctttagccagagtctttcagggaagcactttttgaatcagaatatcatttggagacctctgactaccaatcaaaaaaggctgctcattgggcctaagaaatcttattctctttcgtttctaaggcatctctcaaatgagcaattttgttcaagttagatgttctccaaataagatcttcaccaaatcaaccttggtgaagttaatgcttttcagagatgggcgtaaggattagaattgttagagagtatatgtaagaagcaggagttttttctggaggaggagatttaaacttagacaacaccatgaatgctggctggtgaggctggcgagaaatggaatgtttgtgtctctcaggacatgaaagcgagacggaaggagaacctcattcagttttactggaaacccacagcaaagtttctccaagtagaggccggtgtgatgagaactgctaaatcatgagctgcgaggctggctcaaacaagaggcttatgagccccatgcctgtgtcctttcctacggttttccttcttatgacaagcagcactttttgacagcacaacactaaacactaacacaaaatacagtgaaaagggataaaaagaatggcctgattccactagagatgccagacaaatgagaatcaataacaaaaccagagtaccaaactgagaataaatagccagagacctccacgcagagtgaggtgagccctagtgctgaccacatcggcgcacctgataggccgagaacatggaggcatgaggggcctctgggtggcacaatgggtggaagcctggggacctcagggacaagcagtacagacttaccatgggatcaccaggaaaactgtggaaaccagcaaaggctatttattcacaacttgctatagcaggggaatcagccagcatcacttacttttggtagaaatttaaaaggcccgaaagagatgggaaacttttattgttttgttttgtttaagtatcagattggaaattattggcaggaaatgtttttaattacatttttctgatattaaacccaacacagttgtactttaatattttccctaggagaactacttattttacaactatatcccagtgtatcacccatgatcagccacataatttgaatcatgcattatcttctctccacattcaaattacatacatttagtatttggctacttaaaaaaaaatcattaaaaagtaacaatttaaatccattgatgggagaacctcagttagtttcaaaacaacaattcttgccaggcggggtgactcacgcctgtaatgccagcactttgggaggccgaagctggaagatcgcttgagcccaggagttcaaggccagcctaggcaacagagggaggccccatctctaccaaaaaaaatattaacaattagccgggcatggtggcatgcacctgtggtcccagctactcgggaggctgaggcgagaggatcgctggagtcggaggtggggaggctgcagtgaaccgtgatcgctccactgcactccagcctgggcgacagagcgggaccctgtctcaaaaaatagatgaataaataaataaaaacaattataatggaagtttggataggaatttaaaacatgtggcaactaaccctgaccctgcggcttcagtctccccgccgctagctgagggccgtggccgctgcacagaggcttgtgaggattcgggggttcaggcagcgcccgccgcgcatctgccagacgtgcggccacagggtaggagcagtaagaaggatccagggaaaaaagtccacgaatgagaaaggaaacccagcgtttgtagggctaggagaacaaagaaagaaaatgctggcggcggagggcgaggctctgcggtgcgtggcagatgggaatttgctcggtggcggctcctctttctggagagcttcccagcgtcccctcccccgccagcccgcggtgacgcgcccggcacccaccacagccggctctcggcgccgtcgcgccttcgctcgcccgcttaggccgtgctcgcggtggcgtgggagacagagagcccagggaggaccctggaacatgcagtggtatggaagacgcctaagaaagggcttctctttccactcacgaaaatcagtgtgtgagctcgaagccatttcccagcgtgtccgcctcaactccctcattcaacagatgaggaattcctccagggaaatgcagtgatgcgctcacggctgccggcggcccagcgccaaggggcgctccacagccccgcggcccgaagccctcgactcggctgccacgcaggccccgcggccccgctcggactcccaggatcggcttccgagcgggacagcgctgcagtccacgagtccgggcaggggcgcctccaggccggagcggtttcctgcctcgggcactctgctgtctccacaaacggtttttggaggcacacacacggatactttaaacacgtcggtgatgaatcggtacccagctgccagtggcggagcttcctgggcggggccgcgggcgcgcggcggcttcatttcctcgcgcgcgccggaagtggcctctcaggcgcggcggcgcgcccgggggtgggtggctgaggcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaatgtgataaatttatttctattgtaaagtatcataaagacagaacattacgtataacatgtaattgtgtactttaaaaatgaaacacgagtgccgcagctgttcacgttaaaatatggggcattaccaggggacaggccccttgtgccccttcttgatcacctgtgctcaccctctccataacagtcacactctgatttttatgatcgtttttacttgtttttcttcttagttttcccagttacgtatctcccaatagactgttttgcctggttttgaatttatatacattattatttcattatatattctctttcattcagtgtttttgaggttcactcatattattctcaaaattagttcatttttattattgagtagtatttcattgtactgtagggaggggaaaaactccctcccatcttctcagggtcccagctggccttgaagattaaattggcataggatagattaacaagagaaaagcatataaattgatgtaatacaaattttatgtggtgcaggagccctcataaagaaataaaaccaaaagaagtagagtcagttacttacatactgaattggacaaagactagtaaactgtgaaaatgtgactgtattttgcgggagccttaaaaaatagttattctaacaaggtctgtacaatattctcctggtctcaaacttctcgtcattgaagataaagatgtttgttgccttttcttccagtatagagagtgtctttcacactggaatccatctcctgctcttaagaaacagcacaaaggtcaatcacctttttgcacctgctgtttttcatgtgtctttaatttaaatagtatgccggaatggcatattttaaccccttcagtatgaatgtactactatacttcttctactgttactagatacttgggttgtttccaagttgtttttatattctcttgttggtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtggaccaccttccaccactgggtgagttcattttgcatccttgacagtacttaattttgtcaggcttattaattcttgccaatttagtgggctttaggcatgaactgtagttatgatttatctccagtctttttgttcatttttaccagttcacagggattcttcacatattccggataccagttcttgttggtttaatgtttgcagatatcttctcccatcaagaccaatgtggtttgtcttttcccatttttggtggtactttttgataaataaaaaactaactttattgtgactatcttttttctttatgatttctacttttttcaatagaatttattttttagagcaattttaggttcacagaaaaattgaacagaaggtacgtggagtttccttagatccccctgcccacacacatgcacagttttttctgttacctacatctgtcaccacagtggtacatttgttacaaccagtgaacccacattgacacaaaataatcacctaaagtccatagtttatgttagggttcattcttgttgtacattctatgggtttagacaaatgtataatgacatccagtgttacagtatgatacagaacagtctcactgccccaaaaatcctctaggctgactattcatctctccctaccctctaacctctagcaaccactgatgttttcactgtctccatagttttgctttttccagaatgtcatatagttggaatcgtacagtatgtagccttttcagattgccttcttatcttagtagtatgcatttaagtttcttccatgcctttttatggcttgagagctcatttctttttagtaatgaataatatttcattgtctggatgtaaccacagtttacccattcacctactgaagggtatcttggttgcttccaaatgttggcaattattaataaaactgcaataaacatctacgtgcaggtttttgtgtggacatgttttcaacctttgaacaaataacaaggaacacagttgctggatcatatgataagagtatgtttagcttattagctttgtaggagcgtgccaaactgtcttccaatgtggctgtaccattttgcattcccaccagcagtgaatgagagttcctgttgctccacatccttgcaaccatttggtgttgtcagtgtttcaattctggccattctgtaggtgcatagtagtatctcgttgttttactttacatttacctaatgacatatgatgtggagcatctcttcatgtgcttattttccatctgtatatcttctttttttttttttgagacaaggtctcacactgttgcccaggaggctagaggctggaatgcagtggcgctatcatggctcactgcagcctcgacctcctgggctcaggtgatcctcctgcctcacctcctgagtagctgagaccacaggcatgcaccacctgccctggctagtttttttttgttttttttaatagaaacagaggtccccctatttacccaggctgatctcaaactcctaggctcaagcaatgtgtatcttcttctcaagtgatgtgtattttctttaatgaggaattggtttctactttttattgatttatgacctcataatagggaaggatttctttaaaaatactgttgtatattctcaatatctcccatgtaatttcacttttctcaggtctttaacctaagtggaagagatttttgtgtatgatgtaggtaaggattgcatttcacttacttccagcactacatccatactttacctactgatctgcaaaaccattcttatatccatcagatgtccctgtgtgcatgagtctgattctatgctctcttctgttccgttaggctaccactctatcactgcaccattagcattgcatggtatcagttactgtaattttatgctagtgaatatctgggacacattttccactcaccttgttcttaaagatcgttatggctatcataggctttgtactttcatataaattttagaatacgcttattaggtttcataaaaatgtatgaatttgattagaatatcattgaatctgtaagatcactttggggagtctttatgatatgaagtctcccaatctattctatttggctttattgtttttcaattacattttataatttttcacactgtggacttacacatgctgtttttcagattcttcatagttactctgcatttttgataccattgtaccttatcttttattgtgttactggtgtttagaaatcattgattttgcatgttaatttttgtgttcagaaactttgccaaaaactgttaattctagtaattagaattcttttgcatttttcttgttttacatcatatcatacatatgaatagtgagttttgtttcctttccatttttaggtctttagttctttttcttgtcctcctatgcttggtaggatttgttgtgcaatgctgatggaagtggtaatagtgggctccctgccctgtttctgatttcaagcagtgctttcagggtttcatcagtaagtgtgatgtttgctggaggtgttttcgtagacaaccctgtcaacttaagaaacttcccttctgttattacttagtgagtttttatcctacctaagagcatttatcagatacttttactacatctgttgagatgttcatatactttttcccctcttttaaagtattaaattgatgaattaatagattttctcaagtagctttgcattcttgggacaaatgccagtcagtcatgatgtgttatttttattttacattgtttgatttggtttgctttcatatacatacatgtaagtattcacatttacacatctcatatgtattcatgtcgggggtgtgggtatgtatatacttcaggtgtttttaatctatgttcatgaatgagattgcctatgacttcccgttctcttccttgttgggcatttttgtttatttatttgttgttttaattgacgggatcttgctctgtctccaaggctggagtgcagtgggggcgatcatggctcactgcagcctcaacctcctgggcttaagtgatccccctacctcagcctcccaagtagctgggaccacaggcacacacccctgcacctgactcatttttgttgttgttgtttttgtttgtttgtgtgtagagacggggtcttggtttgttgtccaggctggtctcaagctcctggtttcaagtgatcttcccaccttggcctcccaaagtgcagagattacaggtgtgagccaccatgcctggccctcattaggcttttctgttgaggttatactagcttataaacttaagttacaagtgttccttcttactctgtttctagaaaagttttgtaaaattagaattaatttcttccttgaatattgaactgcctggaagaacggcctgaaagccacttgggcatgaacttttctatctaggaagatttttgatcagttgttcaatttatttaataattatagaactattcagactttctattgtttgtagaataagctttcattgagttattttgggtaaatcataattttctaggaatttatactgataaatttgaaaattcagatgaaatcaatatcctcctattatctgtgtgatatgtatacgatttatagtgatatcctttttttctcattcctgatatacttatgccttctattttttcttgatcagctttgccaggagcaggcagatttttttcaatccttttaaataacccttaccagccatgtatgagagatcagttgctttacctcctccccgacacagtatttccagtgtttttaatttaaactctttaattataatttctagtgggtgtgtacagttcttattttcatcttagtttataatcagggaatgatgtcaagtaccttatcatatgcttattggccatttagatatcttcttttgtgaaatgcctgttgaagtttttctgccttttttaaaaaaaattagtttgattttttttttagttgatttgtgggggttacttctgtattctgaatttgagtcctttgtcagatttacatattacacataccttctcctagcaacagcctctctttcactatgttaatggtatctgtcagtaaacaaaagttcttaatttcaataaaaaccaattttcttttatggttagtgattttggtgtccaatttaagaacctttcctactccagaattttttttaattctttttttgacacctcattgcattgcctttcatatttaggtctgtgatccatctggaaatcgttttgtatatgggttacaggaagagtcaagatccatcctttagtttttcttttagggaaggtctgtggatagcaaacgccatttagtttgtctgtaaatatctttattatctctcatttaataaatagttttaaaaagtagagaattctaaattggctatcattcttctttttagcacaatgaagttactattccactgtctcttggcttcagttatttctgctgtgaatcatcagcgtaacagccatcatccattgaaagcagtccactctcttcttttctgttctgtgtcactatgatacatctgcatgtgggtttgttttttttctggtcctgcttgagattcttcgggttccttggattgttactctgaaaaattctcagctgttttattttcaaaaatgattcctgcctcattgtctctttgcttctctaactctgataacatgttaaaaccgttgtgtcctccatgcctcaacctgtttcttgttttccaatgctttattctgtgttagattctgttaatttcttcagaattatgatcagatttggaaaataaccaaatagagcatctagaaatgaaaactacaataattgaattttttaaatccagcagatgggttgaacaaaattagacacagctaaggaggttttttttttttttttttgaggaggagtctcgctctgtcgcccaggctggagtgcagtggcgccatctctgctcactgcaagctccgcctcccgagttcacgccattctcctgcctcagcctcccgaatagctgggactacaggcacccgccaccacgtccggctaattttttgtatttttagtagagacggggtttcaccatgttagccaggatggtcttgatctcctgaactcatgatccgcccgcctcggcctcccaaatcctcccaaaggattacaggcgtgagccaccgcgccaggccctaaggaggtatttttttaaaaactggaatataagtcagaatgtttgtttctactggatgtttaggggcagtaccagttcagggccagttcaaagaattcttagcttgaagtttgttggaccagtgttgatttgtgctgcaaaattttgtgaagctcactgactcatcattatcaattatgaaggtaaaatttccctgcctccattcagtgctgagattcaaatcagggagcttttcctaggtccctcggtggggtttgggtggagcgccttatttcaagctcactgctgcaccgaggggtggctctttgggatgccagctttatgggctggggtctcctatttgattcttcatcttgaggtgggccctggacttttttctctacccctgtggacttgaaaacagcagctcatggtccttaccctcagggcaaagcaggctgcagagcttccctgacttctctggctccctgccttcacttggatttttaaattttgtacaactttatctgttgttttcagtgggcacgcacttcatctctcacactgccagaaatgcacaagtggcgcagtttactttcttacactcttccctgcactgttgctgaaccactcagccctgctgagcgcgcctgagcatctgcacctgagcatcctggtgctgtgggtagatacttgtggggtgttcagcagcccctcaccttcctcacagtatcctgacttccttgttgggaataaagattgaaattgtgttaacgtggtctaaactggcctgcagatggattgtaagttttgcttcttgaagttttgaatgcaaatttgtgggaattctttcccatttatatttttatgctggttggattgaacagtgactgttaggtgaacagtgacatgttaggtgaatgctaacatgcttcgtattgaccaggaccccaggtgttcctttgagaagggggcctttgcttcacttttcccaaaaggtgctgtggccttttgcagaagtgctgcttggcgtccgcagcaccagggccagtccatagcaagcaccgactgtgctgacaatgaaccaggtgcctgctctgtctgcctttgcttcttagaagcctttgcttcacttttcccaaaaggtgctgtggccttttgcagaagtgctgcttggcgtcctcggcaccaaggccagtctacagcgagcactgactgtgctgacaatgaaccaggtgcctgctctgtctgctaccacggccctgcaagagagccgtgatcagatgaaaaacatggaggctataaggtaaacagcttgtccaagcttctccagctgggggctgaaaccagctctcactccagtttccccggctccttgctccctccctgctgccttgtgcctccctgaggagcagggtctatgttctcgtatgggcgtggtcggtgtgtgtcacaagcagtgtgtgtcacagaagtctccatggcttactacagatccttagcttatcattctgctacatctgacactctgacatccatttgttcctgcaacgtttgtgaagggtgacactcagccatcacacagggatgtactggtcacaaggcacacagactatcacccaccgagtgcttctcacacgtactgtgtggcccagggattggactaggcccccaccgtattgccaattcaggaggtgtgtggagaggcctaagaatggacattcaaacaggttcccaaggacccacacttgaaagccactgccctggaggaactgcccatggcaggggatggccctcccagctcgaggttgtatccaaggccagagcaaattatgcactcccccttcttcagctgaggcagatgaacacttccaaaaataacttcttcaccaggaaattagggatgccattggatttaaagacctaaaaaatgtcattcactaaaagctcaagcatcatctccatgtccccatttgctccacagacacccgagcacctgtcctgcactgcccactgcatggggtggcaaggccccgaggcccagcttctgtccaacacgggcccctggctgtccaaattcacatcccaaattcagcccctgggtcacactagccacatcccagcagacaggacccacatatggttggcagctgctgtactggacagcacagatacaggacattcccttaccccagaaaggtttctgttgggtggcgctcacctcgtgggaatgatgacactgagcacatagtgaaagatgagctgagttatccctggggtgcagtccccaccctgtccaggcctgagaaccgtgggaatgggcaggttggaggagcagaggggagtaccatgtcctgttctggagccttagtttttttccttcaattcccgagctctcatgtgctcccccagtgaacccctcttctctgttgcgcttgagtataaaactcatgacaccaggagtggcccctccagacctgcattctgcaggctgccctgcaggatcgcgtccaggggctctccaacctcccctgcccccagagaggccatctgactcctctgcagtaacacagtccatacagcctggcttaactaggtatcctgaacttacttacttatgtgaccatgcaatacagcagccagtgacatctttttggagctcacaatgaggaaagcaggactgaacgtgcctcctatagcttctttcgagtctcaccttattcagtggaaagccctttgtcacacaaagtgttgccagctggagacaaaagtctcttgcccagtccctcctgggaaggccacagcaggcctggcagcctcaccctcctccctgccccaggggacccatgtctccggccagcagcaaggccaccccctcactgtacacacacagcaggcaagggaggggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgt

SEQ ID NO: 785 - DNA, 676223 bp, Homo sapiens
tcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatattttcttttcccttttttgagacagagtcttactctgtggtacaggctggagtgcagtggtgtgattacggctcactgcagcctctacctcccaggttcaagcattcctcctaccttagcctcctgagtagtgtatgccaccacgcctggctaatttttcttttttttccttttttttttttttctgtagagatggggtttccccatatggcccaggctggtctcaaaactcctgggctcaagggatccgcctgccttggcctcccaagttgctgggactacaggcgagagctactgtgcccagcccatattttcttgactgttttatttttaccttaatttagaagtaattattgttatgaatattctgttgcattatgtttgaggatgtttgtagctctagtgggaatacgggaagttttgatagaggcaaagacattgggcctgcagctgaacagcaggatcatggttatcatggagtctgtgcagtcagaattttccctttttgagcacttttattcatctgggtagacttttgatgttatttaaatttagaacacagcaagaaaaacagaatggaatttattttattttatcagtttttgcctgtaaaaatgaacttcttgtatgctcctgtaaatgtatatgatgttttactggatgcagttaaaaaatgaaaattaagagttgatggttagagttttttcagggtctttttaaagtaaaattttcatcttttcacttataggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatatgtatacatatatacgtacaaatatatcatagtaagtaccatttcttcttggactcttcctggcactgtgctaactgctttctacaaatttagcttacataaacccttgatacacccttgaggtgagtaggtattatctgtagtttacataagatgaaatagagcctgccagcagttaagtaacttgtgtgaagttgggacccttgttcctgatggttccagaaccttcatccttaatgataatgctgaagtaagtacatgaattgccctgaagaagtggtcagtttatcaataaaaagtctagacagtcctcagtgtatggaaaatgtaaatgctcttgcatttatggaaatgatagtgttcactattctgatagtctattaactatcttttaaattagcaaaaataaaatacaaattagcaaaaaaataagccatattgattaggaagtgtggggtgacagacaccttgattttttcatttttatttagttttttctagacacctgtttggtgacaaagagctacagattttatactttggcccaggaagactcctaaaatataaagtaaaaagtaatacagattttaaagttgtgccattgtaatgtcagaaaactaaataacattcaaattttgaacatgtaatgttaatattagtaaaaataagtgttattattaacgtagtgtaagcttactaaatcttgtatacttgaaatgattgaaatagttcatagaagtcatttgtttctcttttatttaaaatgtagcaagcttctaattttaaagacatacatattaagagatacctttacttttttttatttttaattattatggatacataatagttatacatatttatggggtacatgtggtattttgacagaagcatacaatgtgtgatgatcaaatcagggtaattaggatatccatcacctcaaacatttatcatttttttgtgttaggaacatttcaatttcattcttatagttattctgaattatataataaattatagtcaccctattgtgctgttgaacaccagaatttattctaactgtatttttgtacctgttaacctttccctctttgtccctccctccctgctccccttcccagcctcttaaccatcattgagagagatgcccattatgtaaatcttttaaagatttttcaaaaggaacacacacatttggtaaagtactctaactgtaatgcagggtgcacacaatgtgcattttctttttccttagtataaccgctggtctctcagatccctgcagagcagtatccttttagatacatataaacacacatgccaccctttaaaaacaaatggtagcttattttacacactgttctatgctttgcttttttcatataatgtattttggaggtatataatcagtaagtactgcagctctgtctcctttttaatataatattccattctatggaggcaccataatttatttagcctagcttatgttgactgctctgctgtgggttgccaaagcctcctgtgtacagcaaaggcacacacagtacgtggatttgggtgtgtacaggcgtgtgtagattaggggaataacactggcttagatgacaaagactggcagctgagggactgtttgctccctgttcttcctgaccctacaatcagctgcttgccccctggcactctgtggcatcaaatgtagtgtgaggatattccgcctgtcctttgagctggtccagtgttgctgaaaagctgtgcttgctgcctcagtccacagtagcagctgtgctttctcacaagcccaccttcatatattctgtggtttcggattttgaatgtttcctagtttaatcaaagatgggcatttctgtttccattttttttgttatttttagttatctatgcaaagataagaacagaaatgtttttaatacttaaactagaaatttccaggaatcaattctgaaattattttgcatctttgaagcatcttaaattttaaaaattggtctcatctgcttatattttcttatagactaccattcatcgtaatcttactgtttttttttttacctaattctaaactggtagctatttaaaaaaaatttctgagcaattgagttatccaaattaacatataagatagaggtttccactgcatacttctcaacaaaaaacagattgtggtttttttttctatgaggcgattgaaagaagaggttggttttctgtacatatttaatgtatttcattgattatgactctcttcccattctttggatgccagagacctgttatttggcttaaaaataccttacagaaaacttgatttctttaaattaggatttcttaggtaagggccaggttagacccagccttttctgagttacttctcatacattaaaattcttataatggaagtttatatcctagtggacattgtcttatgggttggcttttagagcaagtcagagggtggtggtttctctgtctgggtgatgcctgtgtagtcatttgatttagtctggagtgcaacttttccgtccagggccaggtagtagatatttttggctttgtggatcatatcttctgcagctacttagctctgcagttgtagtgcacaggcagccatagacaatatgtaaatgaattaatgtggctatgttccaataaaactttagttacaaacacaggtgatgggctggattttgcccgtggccagttgccaacccttagtgtaggtggtctgttttggtagtttctttgagaaattatgtgttctgcttttaggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccggtacgaagagaaataattgttggatactaacagtataatccttttaaaatagactgaagaggccgggtgcagtggctaacacctgtaatcccagcactttgcaaggcagaggcggtcggatcacttgagcctagagttttgagctcagggcaacatgaccaaaccccatctgtactaaaaatgcaaaaattagtccggtgtggtggcgtgcgcctgtaatcccagctactcaggaggctgagaagtgagaattgcttgaacctaggaggcagagggtgcagtgagctgagatcacgccactgcactccagcctgggtgacacagtgagacgcttgtctcaaaaaaaaaaaatactaaagagacattactaaacgtctctctaggattcgcctcctgaatttcctttgtgtgtgtattcacagtccctggcctcctgaattcctttgtgtgtgtgttcacagtctatggactgctgaattcctttgtgtatgtgttcagcctctggcctgctgaattcttttgtgtgtgtgttcacagtctctggcctgctgaattcctttgtgtgtgtgttcacagtctctggcctgctgaattccctttgtgtatgtgttcagtctttggcctgctgaattcctttgtgtgtgtgttcagttttctggaaggtttccctcaaaagagtgcttgtttggggcctcttggtgtatctcatttgtctctctctgtacctgctgcaccaggcagtgtctggctgttttggggtcaggacttaatagagtacctcggaagtttctcccagttacaggaccaggcactgccccttcctttctatactgctctggaccattggccacagaaccgtttctgtgctcagacgcctcacctccctctcctcaccatacttagatggatgccccggctcggctgcagagcagtctgcctctgtggggttctaataaatcctgaaagaagccagcaaggctctggaagcctcaggacagtggctttgctggaagtctcccttcttaggattgcttcttgtttagagcttttattttgttgcagtattgatgataatttaattgaaatttaatttttaattttcctctaatgtttagggtgccaagctgttctacctttctggaatggtgcatggagaatatcaaaaccaagaaatccacaatctgggccgttttattacagttatgaagtttaggcctctcacatggcaaacttctcacccttatatcctggcagacaggtaaaatatgattttaagctttttcttcctgggccatatatttcaaagctaaaaaggctagaaaaagaacagtgataggatttattttgtgccgatttgaataggggggatagaagtgtagttgatggaaaatgtctacttatatcattgctcaaagatgccgtgcctttgggagtaaattaattatgagatgttaaggaaaatgggagaacttggaagtatttaaggctacaggatgtggccccatcctacgttcagcctcagttttcagtgatgctgccttcatgcccgggtgcttgagtccttcgtgtgtgccttctgtttccttcctttgtgctcttcctcgtgtggttttctcagcctggaattccctttttccacctgccagaatccaagccacagtaaaaatcccagagcacaggctcgccctcttccagaaagggattttctgaatatgttcttcactcttccccgaccccaggtggacgtcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggatggaagatttgacaaacccagaggatatccgaacaaacatcaaatgtgaccggaaggtgtcactttatggttatttaagaggagcacacttgaaaaataaaagccaaattcacatgccaggtattctcttgttgtagaacatactagaattacacataggattcttgggatggcttcatttctcaggaaaactgaaaaatgaccaaacaagggaagatggccttgctggaggttttaaaagtaagccacctatgtgtaggcctgcaaaggtgttactgaatcccctcttctctgacctcttgtcttgtagctagggggccactgttccagtgtggcacaatgcccttctttagtgttatgggttaagcccttggactgtggatcatatttaaccccctagtcaatggtagatgcttctgacttcttgtcagctgaagctggcttttgggttctgtcttccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggtatcggtgagacgggagtcatttctctgaactttcagtattctttctgaatctattttttaatcacaaaaagtaatgtactcagcttttatttattgaagatttttctcttgtacttataataaaggcccaaatgcatattgtaaatatataggataaaaataatactttttttttcattgtaccaagcagaagagtcctctccttcattcctccttgatccatggccccagcacaggcattgctgctgtgtggcgcctgcacggcccatccccgtttctacaaaatcagtgtgctttccagctttcattggtctttttctcattcacaatggtctcctcatgctgtattttaaagtggatttcaaatatttatttctttgttctgaagtggaattttattgggttaaaatcggcttattttaaaatattagaaaagctagcattgttgtagctttggagctgaggtttttctagctaggttgtttaggttatcaggttatatactccctgaactttggaaaagtttaatggagatggggatccatttcaagctttgttgtaaggattttcttctctgctttttgaggcattaagaaaggttcttaggaaatgtgtctaagataattttgagaaactgagtgaagctcgtgtctctccaggatctttgtgctttcctcacgtgccctttcttggtggtcttgacaggatgaagtggggcccacccatgagctggtccagagtctcatctctacccactccaccattgatgccaagatggcttcaagtcgagtgacgctgttttctgattccaagccacttgggtcagaggatatagataatcaagggtaagtctgctttttttctatttttaataaaaagatgtattacaaaagatcatatcacccataattcagccatcataacacatttcggtgggattcattctatgttgttttgtttttctttgtgtgtgcatgtgtctctgagggctcttcacttacctgacattacaagggagtcttttcttgaaataaattgcaggatgcatttttcaacagaccccaaatattcctcaaataccatgccatcttccataggttgccttttgttttttaagagacctgaagccacttggctttcttttggtggccaaaacactagagcaaagtcagggagtttgtggctgtccagaagccacatgccttgtctctgaaagttttatttagattgtgttgtattatctcctctgggtaggtttccgtggatgtatggctcatgtgaattattttccagtctgggttggggatttgtatacctttatatgcagtggatgtttgcaaaacattggttttgttgtattgatttatgactcccagtaaaatttatctgaaaattttgagattatctagtatgtaatttggtacaatgtgcataaactacctagcagaatgcctgacaggtacgaagtgttcgccgaaagatcactcctttataatgggattactagctattttcacttttgcatatccttctagtcatctttgtctacaagaatactctcctctaatatagttacagttaaaatacataattttatttctatattatcatttccttctttttttttttattatactttaagttttagggtacatgtgcacaatgtgcaggttagttacatatgtatacatgtgccatgctggtgcgctgcacccactaacttgtcatctagcattaggtatatctcccaatgctatccctccccgctctgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgcggcaataaacatacgtttgcatgtgtctttatagcagcatgatttatagtcctttgtcatttccttcttctatacagtctttatgtagtcatcattttgttattattggtgtattcttttttttttgtgacaagatcttgctttgtctcccaggctggagtgcagtggtatgatcttggctcacttcagccttgaactcccaggctcaagtggtcctcctgcttcagccccccaagtagctgggactacaggagtgcgccaccactcctagctaatttttttttttttttctagagattaggtctcaccatgttgcccaggctggtctcaaactcctgggctcaagcaatcctcctgccttggcctcccaaagttctgggattacagatgtgagccactacccctggcctattattgctgtattctaacttacccgtctcttatggtatgattttcagttttttcaaatttatgttttcttaattttatatatcttgctacattaaatagcttcatacagttttcttttatcctgtgattttagcttcctgatgattcttctgtatcagttatagcactggtgacttaaaatggatgttcttcctctgtcattcctcctacgtttgttagctggcatttttaacaaagagctttctcttctcccctttatttcggtatcactgctgactaatgcacttgtgttttgttccatgggttattttccatcactatcattattcttcctgatgcctatgctggcccagatttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtaagcttaaatgtagttggttgctgctatgaacttggctctcgaaatggtaaccaaaggaatgtctacatttaggggtctgttgattctgtgattttgttaactgttgaaaagctgcattgtggatggatctcaagggaggggagacacatgaataagcctaactggaggttggcattggtcgtttcaggtgccctcaagtggaaggaagacctttccagaaaggcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaataccgtccattgcatcatgttatgtcccctatttaaaagtccttcatgagaatttttttgtagattagtgccagaaaaatattcctgcccataaaaatatttatttttttcctttctgagaatgagaaccctgtataacacattttgttctcccttttgcccttgtcctctgattttatgctttactaaacttaccaatatgttctttctggtagaattaatgcaaaaataaatatatagtggtgaactttacattgtgctccctggttactgcatggtgagatcaaggccacatggtgagacatttgggctcagcccactgaattgggaaggttgttgtatactgattttcattcaggttttgtctaggtactcttagtgatgagaggctcaacactctttagagctcttctttaataatctaaagctctgcctttaaattcccttccctcccttcaccgctaatattctcactcctcggcctcttagctgctcccgtgcaggagcacaggagccccacacatgtagagcaatagcttcctggctctcttcatctgtggctgccctgccctctcaatgcctaactcttatgtggccattgccatacccaccacagacagagtccctcagttcctgagttcaaagactcatggcctaactggttgaaaatgatgagtcctctagggctgtaatttttgttctcacttttctgccatggtgtgctctttagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggtaagtctgggtagtacatttgatttattagagaattagcgaattgttctagaataagattatctgatgtcaatattgcttacctgttgttggcttcttatttttacaggattacaggtcattctcccagatattgtagtgggcgcttcatgcatcctaagcagtaacatgttctgagtttagttagaccatgtacatggcccacagaggacaggttcagctttcagtgtggacagtagtgtgcatctttattttgaaacatcacacataagtttttatacatcagatgtattttgtgtcttatcactaggatatatgtagcatccctgagttaacatttatagtttctgctatttgtaagcatagagaaatctgtgatacctgtatatgttcttcctgcagcttaccattttgtagtcacactggaattcattcagtactcaaactcaccacagcttaccctcctcttagacctcttctctttctctctctctctctttaagatatggtctttctctgcagcccaggctggagtgtagtggcacaagtgtatggctcaatgcagccacgacctcctgggctcaagggatcctcccacctcagcctccagagtagctgggactataggcacgagccaccaggcctggctaatttttgcattttttgtagagataatgtttcaccatgttgagctagtttcgaactctgggttcgaatgatcttcctgccttggaacttcccagagtgctgggattacaggagtgagccatcgcgccagcccctttctctctattctcttctggaatgttctgattttccaaaggctgctttctttttgtcaattcagtttggcttagatgtcacttctcacagaggcccaattgctatcatactgtctattgtaattcgccagataacacttaatgtactttatgagattttatttaaccatttttttatggtgaaatttaatacagatatataaaaccacgtaaaaacaattgttcagcctaatgggttgccagaaggtgaatatccctgtactcagcactcaggctgggaaatcaagctttgctgctcaattgtgacaccagccacagtccccttcctccctgtagaaggaggtgtagtccagcctcttaaggtgatgctttccttttcttcctggtttcctcctccatgcttccataagcatcatagtttacttttacttggtcttcattactgtttttcagtctatcttttaacatttttagtcaacagtctttccttcccatttctttctttggttacattttatttaataaaccaagtctttggtctgtagagtttcttgtattctggattttgtggattgctttgcatccctctggagtttcccaggccctcctgtatttcctgtgaatgggtatggagcaataccaatagaacttctgtaatgaaaggaatgtatatctgagctgtgggttgtggctacttgtggctactgagctctttaaatgtggctaatgagactggagaactaaattttaaatgttatttaatcttaattaagattaatttaaatagtcacatatttctagttaccctgtagacaaaacatctagcagttggatgggatttaaatttgatttttatttttcggcgaaactgcttcccaggtgatggtgttttctcattaggaggcgcataaagactggttgtgtccttttaatgctgttagatgttatcagttgttggtgctcaatgcctagaaccataccaatttcttaagaatgtagagtggtgatgttccattcaatcatttctctttatgtattagctgtaacacttctttaaagagaaacttttcctcttctattcggttatccactgccatatatatagggtaaatgcttgatttttttttttttttttttgagatggagtttcgctctgtcgcccaggctggagtgcagtggcacaatctcagctcactgcaagctctgcctcccgggttcatgccattctcctgcctcagcctcccgagtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattctggatataagtcccttatcaggtacataatttgcagatatcttctcccatgttataggaattcagttttcaaacaggtttagattaacaaatagcaagaccaactttgtaaactactgtctcattgcattgccttagaaaccttaataaaattgaaaatcagttgaattagtaattatctgtttgtttacttatgaggtcagtagagtagtagtatttaatactttccctgtctgctgcttaatgtgttttatctctgtggttatactgtctccatcaaaggtaaagttattttctgggctcatttggaatgagaatatccatgaaagtgggaaatatttaaaggcaagttgtcacctactgccatttcttagagttgttttgctgagtgattggaacacctcacctaagtgctgacttttctgcgtaaggttatgaacagtatcagagattgcttcgtgactggaaagtgggaagatgataaagatgcagccaaggtcttagcagaagatggtaagtaaagagctgggttcttcaggaagactggcttctctaaactttattttcttcagtatcttagacaatagtcaaattgaaaataatagtcacttgtcaaatgctttgggaattcagacaggagtaatgaaccaggtaatattctgggttttccttttatgatgatcttattttctcagttggctgatttactgcgtatggactttaaaagtgagaaactttccataaattttaatcatgtgtttgttaaaaatagattttgtgtgatgtgaaaaatatatacaaataacatttatatttttttcataataaaggtagtatgcattgtggaaaatttcgaatgaaaagtacataacataccagaattctaccaacccataaaaaaacctttgttagcttcttcaactgtttccttctagtcatttaaaaattgtgtgtttaaacctttttagttgtactttatataatttttggcaggaggattgcttaagtgatgtactttttataaattttgtcattaaattttttcaaatatttcatttttattatttaaaattaaaaaatattttatttaaaataaataaaatattatttattattatcataccattattgaagtcacaattttttcaatatctaagtagttttatactttgttcattttataaagaactccacactgaacaactttgaaataattcttggctcacacttttttattttcataagacagattcataagtgttagaattgagtcatttttatggattgcaactgccacatggttttttggaaggtcattctttttgttttgtcttgagacaggatgtcgctctgttacccagactggagtgctatggtgtggtcatggcccactgcagcctcaacctcgcagactgaagcctcccgagtagctaggaccacaggcttgcatcactacacccagctaattttaaaatttttttgtacagacagtctttttatgtttcccaggctggtctcaaactcctaggcttaagagatactcctgcctcagcctcctgagtagcttgaaccacaaatgtataccaccatgcctggctaatttttaaatattttgtacagatgggggtcttgccatgttgcctagctggccttgaattcctgggcttaagcaatcttcccgccttagccttccaaagtgctgggattacaggcatgagccactgtgcctagtctgtagtatgtgaatgtattctttatatatatataatttttttttctgggccttctagttaatatcactgatctctgttggttcatttattattactataatttagtactctatgcagctttatcacgttactaagataccagttattaaaaccgtgtctcaacagtttccctttttgttctgctggggggcttcttttaggattctcctgactattctcaccttctcacttgcttattgttttttccataggaacttaagaatcggcttttctgttttcaaaagaaagtgtggtgggtttcttttttaatcacttcagtgaggtataattgatggtaaactacagtatttaaagtatacaatttgataagctttgatatgtgaatataccatcaccacaatcaaaataatgaacacatttgtcacccccacagttttcttacaccactttgtaactctccatcttgtcctcttccatcaccaggtacattcagctgccttgtgtcactattcagtaggttgtgccctttagaatttaattgaaatgggatcctacaatatgtactcttttctgtctaacttcttttactcagcatgattatttcaagattcatccatgctgttgcatcttcatttctttttgttggctagtgggtagtccattgtatgatgtatagcaatttatttatctgttaacctgttgataaacaattatttccaggttttggctattatgagtaaagctgctatgaatgttttttagaagtctttatgtgaaccaccgcttttatttcttttgggtaaataagtagttcagaatggactaaatgggtcatatgataggtacacatttaattttttaagaaattacccaactgttttccaaagtgtttataccattttccattgccaccataactttatgcaacttccggttgcttcactctacatctttcccagtacctgatagtatcagtctttttaaattgtaggccttcttttaggcatagagtggtatcttgtagttttagtgactaatggtatcgaacattttttcatgtgcttatttgccgtctgtgtcttctttgatgaaatatctgtccaaatcttttgtacattattttaattttgttgaattctaagaaattttgtgtatttttgatacaaattctgtatcacatgtgttatccaattatttttgcctagcgtgtgccttgtcttttctatttttaatagtgtttttcacagagcaaagtatttagttctggtgtaggtcaatttatcaaaaaaaaatttttttttttttgggatggagtcttgctctgtctcccagagtgcgatgtgatctcggctcactgcaacccctgccccctgggttcaagccattctcctgcctcagcctcctgagtaactgggattacaggcgcccgccaccacgcctgcctaatttttgtgtttttagtagagatggggtttcgccatgttggtcaggctggtcttgaactcctgacctcaggtgatccatccgcctcagcctcccaaagtgctgggattacaggcatgagccactgtgccctgcccaaaattttctcttatggactgtgcttttcatagtgcatgtaagaaatctttgcctcacccaatgtcacaaattgtctcatatattctgtaagtcttacagtttcaggttttacgtttaggtctataattctttttgagttaattttttatagagtgttgggtatggatttaggttccttttgacatattgatatctacttttccctgcaccatctgctgaaaatctatttttttccccgttgaattgccctgtattggttggccatatatgggtgaatatttctgggctctctgttctgttccattgatatatttgtttatttttgtaccaataccaacactgtctctgttacttacagctttataattagtcttggaattaagtagtttttaactttaggtagtttttcaaactttagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctcactgcagcctctgccttccaggttcaagcaattctcatgccccagcctcgtgagtagctgagattacaggcagccattatcacgcctggctagtttttttatttttagtagaaatggggtttcaccaggttggccaggctagtctcaaactcctgacctcaagtgtgtgtttggaggggaggggtaaactttgactaaacagtattcatggttttctaagtaaatacttcttactatcccaaggattctttttcttttatgctgctttttctcctgttctgcacaataaagcctgggcttccaattctgctttgacctttcaccttggtccaatctcatatggttcccccagtttctgtgcaggatggttctgggagccaagcaggaaactatctacagaaaggctgagatagatcccagtggttttactttctttctttcctatctggatgacttaatttttcttgccttactgccctggtttaaacttccaggacagtgtggattagaagtcaaagtaaacaaccttgctttgtcctgattttgcttattttccaagtgaacttaagaatcacctttctggctgggcacagtggctgacgcctataatcctagcactttgggaggctgaggcgggcggatcacgaggtcaggagtttgagaccagcctggccaacatggtgaaaccccgtctctactaaaaatacaaaaattagccaagcgtggtggcacacgcccgtaatcctagctactcaggaggctgaggcaggagaattgcttgaacccggaaggcagaggttgcagtaagctgagatcgcgccactgtactccagcctgggcgacagcacgagactccgtctcaggaaaaaaaaaaaaaaaaaaaaaatcaccttttctatttccaaaagaaaagtttgtggtgtgttttttcctaattaaacttttaagtttgaggtaattgtagattgacatgcacgtgtaagaacaaatacagagaaaaaaaaagaacgaatacagagagatctcctgtatcttgtactatagcagtatctgtgtatatatgtactatgtatactatgtgtactgtaatacaaggtcacagcctggatgccaacattgatacaatctgttgatcctatgtagatttctccagtttcacttatgtgtgtgtgtgtgtgttttacgtgtgtgtgtgtctatacttctgtgctcttttatcacatgtgtaggtttgtgtgtctaccaacagttaagatacggagcagttccatcacaaggattgcttgtattgctgttttataaacacacccacgtccctgctgttccccagcccccagttccttcccttgtgaaccataatgtgttttctgtttctacaattttgtcatcttcaagaatgttaaataaacagaatcatacagtctataaacttttgtgaggggcttttttcactcagcataatttcctggagatccattcaagttggtgcatataccataggtcattcctttttattgctgagtagtgctccattgtatggatgtaccggtttgtttaaccattcatccaagatcaagctgggttgtttacagtttgttttgttttgttttgttttcagacagggtcttgctctgatgcccagtctggggtgcagtggtgtgatattggctcactgcagcctcgacctcctaggctcaagtgatcttcccacatcagcacccccaaggagctgggactacaggcatgcaccaccgtgcctggctaatatttttttatttgtttgtttgtttgttttgtagagacaggatcttgctgtgttgctcaggctgatcttgaactcctggcctgttttcaatttttgactattagaattgagctactatgaacacttgtatagaagtttttgtgtaaatatgcacttcccatttttctgggaaataaatgcccaataatgcaattgctgggtcatatggtaattgcacagtttcataggagactgccagagtagttgggccatttgatgtttctactagcaattatgtgagtgatccagtttctttacatccttgacaatgtgtggtgttctcactgttgtttattctagctattctaataggtatgtgatatttcattgtggttttaagatatacttccccagtggctaataatggtgagcattttttcatgtgtttatttgcatttttatatcttctatacagataaaaaatgtctggggatgtcttttttttgcacttttaaaaattgggttgggttgggtactgtgagttcattatatgtttaactccatcgtcggatgtgtgatttgcagatactttctcctaatctgtagttttcattttcttaacggggcctttcacagagcagaagtttttattttttatttatttatttatttatttattattattattatttgttttttgagacagagtctctctctgttgcccaggctggagtgcagtggcgcgatctccactcactgcaagctctgtcccccgggttcatgccattctcctgcctcagcctcccgagtagctgggactacaggcgcccaccaccacatccggctaatttttttgtatttttagtagagacggggtttcacagtgtttgccaggatggtctccatctcctgacctcgtgatccgccttacttggcctcccaaagtgctgggattacaggcgtgagccaccgtgtcgggccaaaagtttttatttttgatgaaatccgatttaccagttttttatagtattttttgttttctctttacacccatgatctattttgattttttcattttatgagatatgaggcttagctcaaggtttatattttcgcctgcaattgtataatttttctagcaccacttattttattgaattgcttttgacttttgtaaaacattagttgagcatctttctgtgaatctgtttctgggttctcttgtgttctattgacttcacatgtcaatcccttggccagtaccacccttgctgtctacgttcctgtagctttatagtgagtgttaatgttgagtagagtgactcctcttactttattcttgtttttcaagattggttaagctatcccaaggcttgtgactttccctataaattttagaataaacttgtttatgtctacaacaacttacctgggattttggtagggattgcattaaacctatagatcagtttggggggataatctttttctattttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtttcattctttactcttttgatatagattacactgatccttttattttttgagacatggtcttcctctgtcacccaggctggagtgcagtggtgcgatcatggctcaccacagcatcgacctcctatgctccagtgatcctcctgcctccacctcccacgtagctgggactacaagtgtgtgctatcatgtctggctaattttttttttttttttttttttgtagagccaggtcttactgtgttgcccaggctggtcttggcttcaagggaactcttggcttcaagggatcctcccacttcagcctcccaagcgttaggtttacaggcaggagccaccgcacctggcctgattcattttttgaatgttgaagcagacttgcatacctggaataactctcacttgatcatgaatgaaaatgaaaatacaacatatggaaatgtgtgtgtttttttgttttgttttttcctttcatgtcagatggttaatgtgctaatgttgtaacaagggtcaagggtggcatatcccacatacatgcatgaatacccagtcatcacacttatgaactacgaaaagatcaccatgtgaaaatttttatacaaatctttttatgtgttgttggattccatttatagtactttgttgaggactttttgcattcatgagagatactggtctgtgagtttttttgttttgttttgttttttctttttgtggtggtactgtcttcatctggttttggcattgggataatactagcctcataaaatgagttgcaaagtgtcccctattctgttttctggaagagtttgtatagaattgggatgaattctttaaatatttggtgtaattctccagtgaaatcatctgggcctggagatttcttattccagaagctcttaattacaaattttatttctttaatggttataggacgattcagattatctatttcatcttgcctgaattttggtagtttatgattttcaaggtgtttcaagtcttgttagggaagtggaagttgcactgagtgccttcttgaagagaccagcttgggtagtctgagggtgatgtttagagtatttgcttaatactctttaacggctgcaggagcctttttgataacccctgttttattcgtgatgttgttggtttgtgtcttctctgtttttatctttgtcgtaaaatttattaattttgttgattctattcaaatgaccagctttttgtttcattgattttctctgtttttctgctttcaatgttattgatttctgccctttatttattattattattttttttttgagactgagtttcactcttcttgcccaggctggagtgcagtggcacgttcttggctccccgcaacctccacctccgggttcaagtgattctcctgcctcagcttcccaagtagctgggattacaggcatgcacccccacgcacagctaattttttgtatttttagtagagacagggtttctccctgttggtcaggctgttctcaagctcccaacctcagttgatccacctgccttggcctcccaaagtgctgggaatacaggcatgagccaccacatccggccaatttctgccccttattatttctattcttctgcttgtttggggtttattttgttctttttgaaatttcttaggttattggtttatcttttctcatttctaatgtgagcatttagtgtttaaatttccttctcagtactgctgagctgtaccccacaaatgttcacgtgttgtattttctttttcttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcacgtgttgtattttcattcatatttcctttgggacttctttttggcccatgcattatttataaatatgttgttttaattatcaagtatttagagagtttcctgtttttctgttatagatttctagcttgattatattatgttctgagaacatattcttatgagttgaattattttagatttgctgtgatttcttttattgccccaaatgtacttcatcttggtagatttctattgactttaaaaatgtgtgtattttgctgttggagagtagggtgttatacggatgtcagattttgctggctcactgttcagatcttttgtaaatccttgctccttttctgcctagtttcactctgtcacttacgctagagtgcggtggcatgaacatgactcactgcagccttgacctcctaggctcaagcagttatcctggcttaacctcctgaatagctggtactataggtgtgtgccgccacacttggctaaattcaaaattttttggagagacaaagccttgctatgttgcccaggctggaactcctggcctcaagctatcctttgtctttgcctcccagagtgctgggattacaggcatgagccactgtgcccggcctccgcctagttttaacagttgctgagaggagggtgttgaagtagatgtcttcttggtgggttaatccttttgtcattaagcagatgttacggtcacttccttttcaccccattggtgaaggaggggtccctgccctaaagtgtaggagatggctgaacacgacacctggcgtggatggatgagactgacagcagtgttttagtcacatatacccacagctcagaggaggacactgcatgccacgcagggtcagatgggcaccatactctgtagtggagtgagggctgggggctgaggaaggaggcaggcttggtagtaacaagagcacacaatgaccaatggttcctgagggggaatgcaattggcttgtttgaataaattcatgggctggcagacaggtgaagtgaaacttcttaggctgaggtgcaaccgttctggctgataaaagaactagccaggtggggagcctttgctgctgggtggcggggtagggggtgtctggtagaaacaggaaaacccacggctaggcctttggggccctgtgaggctcaaagatgtccaggcagcataggaaattttagatcttaaaattcagcgaagaccctctccagctctggtaaattattttgcttgaagtctacttcatgagatattaatatattcactcctgcttccttaaaaaattaatgattacataggatatctttctccattcttttactttcagcctacttaggtccttaagtgagtttgaagtttcttatgaacagtatttagttgggccatgtgtttattataggctctccatccatccgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttgaagtgtttgctctggatgttacaatatgcatattgtaatatagtagtctactggtaccagtatttaccacttcaaagtgtggaaacctgccttgcatttatgtctctttaccttttccgcttgtatgaatcactggcttgagtattaggtggtggtatagtttttgtttcagttgtcaagtgtgattttaagaactgcggattgtctcgtgtatgtatccacatttctggtctttcctttgtccctcctcccatagtcccatattcatcccttctgcataagaactttctgtagccatttttttattttgatttttttgttttaattttttgtattgtggaaatgacagaacatatttctgtagccactttttagcatttctaaatttaccagagacaaattcctatattctcttcctctgataatgtctttatttctctcttcatttctgaagggtagtttcatgggatatagaatttgcaaccaacagtttttttgtttgttggtttggtttttttgtttgtttctttggttggttttttttaagcacttgaaaatgttgtgccacttccttctggcctccatggcatttgagttggcatgtccctacaggcattctgccatttttggtctttgtttttagttttgaaagtttaatcagtgttgctttcttttgttatactttgaggtttgctcagcttcttgaatctgtaagtttatatctttcactaaatgtgggaagcgtcaggaattagttatttgcatgcttttgcagctctggtctcctgtgggactcagataacataaatgcggggtcttttgttattgtcccacaggtccgtgcagctctgttcatttgttttcaggttattttctctctattgtttagactgggtgaattctgttgatacaggtttcagcttctctgattctctcctctgtcgtctccacttttactcaatagagcccatctagatagatttttttttaatttctgttactgtattttatatttctgtaatttccatttgattcttcttcagtttctttgctgacgttttcagttctttgtttgttgccataggatttgtagttgcttgttgaagcatatttatgctgactgttataagtgatgagtcagatggttccaacatctgcctatgtaatttttttatttttgcaggcagtcctcctatttgggtttagtctgtaggtcctggtctactttgtgggctgtgattccaatggcaatttaatttcagagccttcatggtgttattttggtctgtttggcttatatgtatcactgggattctcccaccagtccctgctgttgcccacctgagggaacaggggagctgccccaggctgggccacctgctgcagctaggtgggtggggagtggtggttgtcttggtgtgtggagctggttttcttgttatggggaagatttcctttgatctggggggactgagtctgcctgggttgccttctattgctacgttgggagttgggaaactctgggcctggtcaacttcctattggatgaggtccagggagacacctggccactatgcattccctagtcctagagtccctcagcagcctttttctttccacctttcagaattctcctttgatcatctcctgtctattatttcttaggagggtataatgtgttatcttctctagaccagaaatccttaatggtggtttcaggttgtaactgtgctaaagggagaattggcgtatttttgatgttgagtctttcttttcaaatgaggacatatcattattcagtagataatatttacaacacctacttccttgggttgaagaatgtggttaaggcaaggaaagtacttaacacagtgcctggtgtggagagcaccgatgagtgttggtggtgatgctattccttttgtcctttggtagcatattaaagcttttcttcttttttaaaaaaataaagttctggtgcatttcttgttaggtttattcctattttatccttttttgcttttattacaaataggagcttcctatctattataacttctacctggttctttggcccttatgtgaaaatgttttaatagccttctaaacattgctctcccaaatgagttttaacttgcctatttcttttattttcctttttttgagacagggtctcactctgtcacccaggctggagttcagtgatgcaattatggctcactgcaacgtctgcctcccgggcccccaaagtgctgggtttacaggcgtgagccactgcacccagccttacttgtctgtttcttttaagagtgggaactataattgagcccagagctccaaaaacaaatgaaggaatgaatgagtgaataagctcttcccatgggtttggtgtggtttggggctctactcttaatctaaatgctatgttttatataacctaaaatttcccctaggtgtgttacacgattgtgttgtgttgaacttacattgagactccttttcacatgtgctggtatcagcgtggagcttttctattcattccttgaactattcgtttgggggacacacatagacctctgtgtctttcataaagagtgtccattggccaggtgcagtggctcatggctgtaatcccagcactttgggaggctgaggagggcagatcacgaggtcaggagttcgagaccagcctggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagcagtaccatgttattcagagacaaaggttgtgttgtgttttcttttgttttattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacaggtgagaaacctcagttcctctcagccccttgtcaagactatcatatagcgcaggaatccctgactttgtttgggtccctacgtcctatcctgcttctgtgtatcctgcttctgtgcctttcattcggactcctgggtagagatgcatgtgagtgtgtttattcatgcagtgagctcattgtttctgcagtcagagggtcaccagaaaaagatccatacctattttgtaacaagaattaggaaacagaaatgactgagacatggtctctacttttgagacatggtcttacaatgtagtgatctgagacagtgtgttcatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctaggtcttcatctagtcaaaggactatttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaatattgtaacactggccgcaggttgatatggaccacttccagtgtgactagtgtgattgaggaactgcattttaaatattatgtaattgtaattaattttaatgtaaatagccactcatagctcccctatgggccaggtcagagctctgataaggctggatatgggaggaaaccctggtagagggctgaccgtggaggttcttttggttttggagtgaatcaggaaacagccatcagctgagtgaaggtgagggtggtggtgggtgtttgaagacaagggaaaagtgtgaaagaattgttcagaaaggaaagaaagaagatgtggactggggacgtttccagtgttcgggcatgcagggctccacagttatctacatttgctgtcccttggagcaggagagaagaaaacggttgggacatattctgagcagactgtagaggtaaaatatgtaggtctttttttttggttttttgttttttgagatggaatctcgctctattgcccaggctggagtgcagtggcacgatctcgactcactgcaacctccgtctcccgggttcaagcaattctctcacctctgcctcctgagtagctgggactacaggcacgcaccaccacgcccagctgattttggtatttttagtagagacggggtttcaccatgttggcgaggctggtttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttattatgtacatgagactttaagttgaaaattactcatttttattaatacaaagtaaatttccctttgcttttaatcttcctacatcgttttcagtagggtgtgggattagaggaggggaggtggaagaattataatggtacatttcctatttttgtgcatcttttgcatttatttatctaagcaagtacttaagcagtgctcaccatgtgctaagcactatatgaggttgtgaggagccatcagagactccctgcagccgtgcagggagtccattttcatttgaccagtcaggcagggcagggtttattggtcccatttaacagagaagaaagcagaataatgagcagatggaatctgccctggagttccaaattttaatttcctaaacattgcaactgtatttttcttttccatttcattccaaataaatcattatagtgaaattacattcctctgaaatcactctcaggaaagtactcaaggcgccttttttttttttttttttttttttttttgagacagagtctcactctgtcatccaggctggagtgcagtggcacgatcttggctcactgcaacctctgcctcctgggtttaagcggttctcctgccttagcttcctgagtagctgggattacaggtgtgcaccatcatgctgagctaatttttgtatttttagtagagatgggattttgccatgttggccagactggtcttgaacttctgacctcaggtgatccacccgccttggcctcccaaagtgctgggattacaggtatgagccactgtgctcggcctcaagtcacccttgttagtttggcttaccaactttaaagttttggattgcttttgtcaaaccactgggttgcaagttcacatggtctctcttgtttttcttagctaattgtaagtaaaattcactttggtaatttattgtgtcacatagaattgaagtttttctcttgctgatattattcctattttcaaattttggggttcctgttagcctgattttcggatagctgctacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctttaaaatatgggcctcatatttttataaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggttttgtttcctactttttttatttgtgttaagaaagggaaaaaaatcacaagtttgtctaaccattcagtagaaaaatcgacaaagcatttgcagacaacttggcaaggttacagagaaacggatatactgtttttcagtatttggggaggttggtttgagcagcatttattgagaatttcattagtggggatgtttctattgaaaacacagagttagaaagtcataaaatgttcttgcaatataaggtaataataccaccagcgtttatcttactgttttcatgttctaagtgcatgcacctgagtaaaagcatctgggctgcagtccagtctgagagatgccaggaaaggctgcctaggccagttcagtccagtaaatccctcttcgatcttctcttccacacagacagcggtgatgagcatgcccatgaactgacatgattattttggggaaaatgaaagacttgtattctttttgagatagtaattccactttcaggggcgaatacattttgtttattttatcacccttcagtgagttgtttttgttctttaatcaaggatgtatgtttgaagtaagaagtaaagcataaagtatatgattttgtgtgtgtgtgtttttatcttgctatacctgtagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcggtgagtgtcttgagtagtgttcagggcagggtgttaccattcatgcttgacttctagccagtgtgacgagaggctggagtcaggtctctagagagttgagcagctccagccttagatctcccagtcttatgggtgtgcccattcgctttgtgtctgcagtcccctggccacacccagtaacagttctgtgatctatgagaatagtttccttagcgagcttttccttcaaatactttgcagccaggtagagaagtttggagtgaaggttttattctttgtttcttcgcaatatggatatgaatcttcttttgaaaatgttaaagtaaattacctctcttttcagatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataaggtactggtcgcgtgtgtgttagtggagatgaagcctgtgctctacagacagggagtcacacagacacttttctataatttcttacatgctttgaatgttcaagtataaagtctaacgttaaatttgattgaacagttgtatatttgtggaatattttggaatggaacaccaaaaaatgataatagtggttctttctggattgaagacaaacttttcttttttaaaataaattttattttatatatttgaggttgaccacatgatcttaaaggatacatatagatagtaaactggttactatcgtgaagcaaattaacatagctaccatttcacacagttagatttttttgtgtgtaacaggaacagctaaaatctacttacttaacaaaaatcccaaagacaatacatttttattaactatagccctcatgatatacactagatctctaacttgttcatcctacatgtctgctactttgtattgttttaatatacatctccccatttcctattggtcatttcctatttggcccatttttcaactgggttgtttttctgctattaagttgtaagagttctttactgatttttggatattaacactttatcagatatgtggtttgcaaatatttctcccagtctataggttcccttttcattttgttggttgttcctttgctgtgcaggagctttttagtttgatgcagtcctccttgtttatgtttacatttgtagcctggcttgtggtgcgatatccaaaaaattattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatttttatatattgagtttataccttgcagcttaactgaattgatttagtagttctcacacttttttgtggaatctttggagttttttatgtaaaggatcttgtcatctgcaaatagagataattttacttctttaatttagttgccttttttttctcatctgattgctcttgcaagtactctattgaataaaagtgatgaagctggccatccctatcttgtattcaatcttagtggaaaagcttttagttgttccccactaactattatgtagactgtgggtttttcataaatgggctttattacgttgaggaactttccttctatacataaactgttaagaggttttatcaagaaaggttgctaaactttgttaaatgctttttctgcatcaattgaggtgaacatgtcgttttatctttcattttgttaatgtgatatatcacattgattgatttacatatgttaaaccagccttgcatgccagggataaatcccacttaaacacgatgtataaagtttttgatgtgttgttgaattctatttgctaaaatttttttaggatgtttgcatcagtgcttaatttattggagaagttgacctgtagtttttgtttgttgtgtgtgtgtgtgtgtgtgtgtgtgtgtgtgtgtgtgtgtgttttggtttggcttaggtattaaggtgatactggcctggtaaaatgtgtttggaattatttcctcttgctctatttttgcgaagagtttaagaagtaaactcccaggggatgggagtgactctggacatgggagtgacataatagtgactctggaccctacagtggtgggacacagcagcatctcagtctctacgaggccaggcgcagcatcagcaaggaccccagaatgatggagcactactgtggcttgggccctcgggggcagggaccagtgcagcaactacttctctccctggggaggcaggtgcctgggcaactcagattctccagggctagtccagttccaaggaagcagggttctacagttgtttgtcctgaagggcaaggtaccccagttcaaccaatgccattttcctgggacgtgggggtgccatgttggctcatccctggcaggtgtggctgctcagctcagccaagacactgattccctgtgaagcaggacagtgcttcagctcttgtgcagtggggagtgtgactgctcagactggccaaggcactgattccctggaaagcagggcaccaagtcaactcaggctccaaggggcagggcgcaatggcagctgggaggggaggggcacggcagcgtggccccgcagggtggggtgcatgctgtgatgtggacatcgtttgttcccaccagcactcatgttgaaatttgattccaaatgtggtggtgtgggaggtggggcctagtgggaggtatttgggtcacagggcagatcctttatgaatagattaatgccttttcatgggactggattagttaccaggagtggattgttaccagagtgagttcagcttcctagactctcgtgtttcctctcttgccatgtgagccccttgcatacacctgtttccccttccactttccccatgaggtgaagcagcacaagaccctcgccagatgtgctgcctgatctcagacttttcagacacaagcagggtgagccaaataaaccttttttataaaataagttaccgagtctcaggtattctgttacagccacactaaatggcctgagacagtgtaacagcagctcagtgtaacagtggcccaccggccactaggtgggggtgatatagagcaacaaagcctgaggatggaagaagggtgtggtggctgctcaccctgggtgggacatgctcccgaagtgattccaggtccaggagggcacgttgcagcagcagctggtccatgggggtggggcacaacgtcagttccttctctgaggggagtgctggggctgctgggcccctcttgcttccttatccccacagggagacatcccctctgcttcaggctgatccctctgggggatgggtggtggggggcagatatttccttctctcctttatgtgaccatcctagttttctgtgctctactagatttctgctactccttgatgcactctggggctctcctttagtgactttcatcaaaatatagttgtttgctgctttggctgtctttgtcaggggatgagcgcaaggggctattgatcggccccttgctggcatcactccctcttaaacttttcactgggtactcttttgaactatttttttccccaccatatacatgtatttttaaaacattaatgtgctaatttctattaaagcaatgtggatttttctgaaagttttaatgttttaataagctttttattgaaatgttaatgtacatacagaagagtgcccaaatcataagtgtgcagctagatgaactgtagcacaccagctgccacgccctggaccaagcagtagcctcgccctgtggcctctcccaggcactgcctccccaacccacaaaatagctactttgccagttcctgacgtagatttgttctgcctggttttgacttttataaaatacagcacattctatttagcctggcttctttggttgagtattacagaacacatccatgttcttgtctatggcagacattgatttattgtcattgttgagttccagtatatgactgtgtcaccatttatccattgatgggtaaaatgatttcctatttttggccgttatcccacggcccttaacactaaggtctggatatgggacttgcaggtacggaggggcacacacacttctgctggaggatccctgggtagggtggagactccagggcacctgtgctctgcttcagtgtggaggcttctgtgtcgtgttctgggagcacagcggcttggcctccaccaccagcagcagcttaaagagttcctgctgttccacgtgcttgctgacaattggcctcttcagtttttttttttttattttaggttttcaatgcctgcctggacttgtgttttcatttagattttggtttcttagaactgttgttattctcttcacagcttaacaatgcatttgaaaagatttgttttcatgtggagtgttcagttttgtaataagagggttgttcaaggcatcagtctgccactctgctagaaacagaagtctcccaggcatttctttttatataaagtagttaatgaaattttgaaccgtcttacatgaatttttattaaaatacacttcaggatgtggtgcccattatccattctactcttttgtaacaagtagatttctctgaattcttgaattcaaaaacaatcggggttcctaaacaaagaatatggaatattattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaattgtatgagtcagtggcattaccttcacagtgctgttgcagccatcttcagagcctttccatcatcctaaactgaaactttgtacccactaaactacatcttctcattccctccttcccccagcccctgcaaccaccattttgttttctgtctctgactactctagatacttttgcaaatggaatcatacaatatttgtctttttgtgtcttgtttatttcacttagcatactgtcttcaaggtgtgtccagttgcagcatgtgtcagaatttccttcccttttaaggctgaataatattcccagtgaatgtctttaccacacgttgcttatccattcatctgctgatggatgtgtgggctgttgggaataatgttgcttgaacattggtgtgtaaatatctgtgtgagtctctgctttcagttctgtgtgtaaaagtggaattgctgggtcaaatgtcattctgtgtttaattgtgtgaggaactgccacactgtatccacagttgctgtggattccttacatttcttctagcaatatgtacaagggtttcaatttctccacagcctagaccaccctcattactctgtttttttgttggttggttgattggtttcttaaaaaacaggcatcctagtgtgaagttgcatctcgttgtgatctgtatgttgggaatgactagtgatgttgagcatctttctgtgtgcttattggctatctatagaccttctttggagaaatgtctattcaagtcctttgaatcagatttttttgttgttgaattgtaggagttctttttatattctggatattcaaccgttatcagataaaccattcacaaatattttctctcattctttgggatgtcttttcactctgatagtgtcctttgatgggcaaaggttttttaattttgaagtccaatttattttttcttttgttgcctgtgcttttagtgtcatagccaagaaataaccaaattattgtttagttttttaaaagtatttatgcgattatttggctgatacctgtctctaatgattgacggcacttcttgagggtggcttttaaacatgcaaatttgatgtcactttccgaggctccttccatggcttccctttgcttctaggccgcagcccttgtccttgctgctgctctggcccctgccctcctctagggcctctcttctgctgcctccagctctggccacagtggcctttcattcgtcggtgcacttgcctggggtcctcaacacatgcagttccctctgcctggaatgcggcagctcctccgccccctcccggcctccacctcctcgctgctccttctgaggctggccctgagaccactggtcggtgcggccttccctggaccctctccgaactccccagtactcctccaaacttttctccaataaaccagtggcactcagttgtgctgtccagggacccctgggattttcacgacccctgtcggcggctgggtgaggtcaagaatgtttcatgacaataaggagatgttattgacctcttttcactggaagtgggagcgtcttgcgggggggcagcgggctgaggatgcggctgtgttaggacgtgacagctcgcacaactgaagcaccgccactttcccacaattttttttttttttttttgctttggaaaacatttctcaagaaaatatgcgacttatgttaccatgtaatgggcttgcttctgttattttaaaacaaactaataagtctcctaaatgtttctcggctttattttttgttgttatggttccttttcttctgtttcccccagctttatgaaggtgtaattgacaaacttgcatatctttactgctcacagcgtgctgttttgctgcatgtgtgccctgtggaacgcttcgtggcgctgctgcaaacctccatcacctagtgctgtgagggcccctgggatccgctctcccagctctgcgccctctaccccctgctgtgcctgaggcccccccacctccctcggacccgcgcccgccgctggaaccgcacccatggcccgcgccccgtccccgacccggctttagtttccacccacacgaagaaactcagcctcggtcctgtttaggcacggaaagggctggagaaccgcgtccttccgaggcgcccccagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtcactccgcgccacgccccgcgcgccaacaccggaaggtgaatgttcagaacatttttatcatttaaagccagtatattggctgggcacagtggctcacacctgtaatcccagctacctgggagtccgaggcaggaagatccgattgagcccaggagttccagagcaccctgggcaacatgacaagaccctatctctacaaaaaaaaaaaaaaaaaagccgagagtggtggcgcgcacctgtggtcccagcaactcgggaggctgaggcaggaggatgacctgagttcagtaggtctccagcctgggcgacagagcgagaccctgtccattaataaataaagccagtgtacctaaaataccatcacaacatggaatcagcataaaaatgattattgaactacttgacattcctgttttgtgctaagtctttgaaatttggtgtggcgttttgttttgttttgttttgttttttgagacagagtttcgctcttgttgtccgggctggagtgcaatggcacgatctcagctcactgaaacctcagcctcccaggttcaagcaattttcctgcctcagcctctggagtagctgggattacaggcgcccgcgaccacgccgggctaatttttttgtgtttttagtagagacagggtttcgtgatgttggccaggctggtctcaaacccctgacctcaggtgatccgcccacctcgacctcccaaagtgctgggaccacaggcatgagccaccgtgcccagcccagtgtgttgtactcttatagcacctctcaattcagatctaaattttgtgggaaataatctatatttagatttcacagtattcacagttgaaaaaatagatgtatatccccttgtttcaaatgtaactgaacctagtcacttgtttgaaattcaaattaattaaaattaaaaatttccagttctcggcaccagttacacatttcaagggctcaatggccccatgtggcagtggtcccgtagaggacggcacagctctagacatggtgtaggaagttggagaaggcttccttagggaagcaagtgacggttgagccatgactagaagttggttaacttggcaaaggctgggagttggggaagcagaagagtgtgtcaagcacaggaatgttatgtggaaaggcctgtgacacagggcagcatgacgcctgcaagccagcgtagctggagccaggacagcagcagagagtcctaggagctggagaggaaaatagagaggcaggggatgaggccgccttaagaggctatcttcatcccgagacaccaggaagccctgggagaacatttagctgggacagcgtggttagatttccatttttcaaaaagcccctttgctactgggtggagatagtttgcaggaagtttaggggaaggaggcacagagagggagaagtggtgggtgctagagctctgagaggtaacattggaggggtagtaggtctgggggttgtgaggaacaaggggttttcagggagtaccccagggcccccaggtgtctggctgggatgccaggtggagtgatgggcacctgtgggacagccaggcagagacatctgaggcggcagctggggaactgtctggaactccggttgatgtgctacctgggcttaagatgtactcccaagagttaccaacacctacacttgggagtgggtgcattatccagggaggagccaaggttgaacacaggtgggtttttgttcagcattttaaaaaattttcatttttttttgtagagacaaggtctcattttgttgcccaggctggcctcaagagatcctcctgccttggcctcccaaagggctgggattacaggcgtgagccactggtcccagtctgttcagcactttttccactagcttagtatctccacatacctcaaagagatcaccaagtccaactcatacatgcaaaccagtgctcaggaagtccacatgatcctgctgtggttcatttgaccaaaactgagcggtggagctaagcaaggctgtttcacagaagccagatatataagtgtcctcaatatggagggcagtcaccatctcccagtgtctctgactgctgcaggcacacttggcaaactgtgctcaggtcagggatggtctgggtgggggctccagtttctgccactcaccagtgatgtgactctgggcaatgtacaaaatctcttgggttttaagtttcttagatggggataataaaccaatcttgcagcatgtgaggatttaatgagactacagttcccatgaaggggatggggtgctgaccttcccacacagtcaaaaatccacatataggccgggtgtggtggctcacgcctgtaatcccagcactttgggaggctgaggcgggcagatcatgagttcgggagtttgagaccagcctgatcaacatggtgaaaccccgtctctactaaaaatacaaaaattagtcaggcgtggtggtgcgcacctgtaatcccagctactcaggaggctgaggcagaagaattgcttgtacccaggagatggaggttgcagtgagctgagatctcaccactgcactccagcctgagggacagagtaagactccgtctcaaaaaaaaaaaaaaaatccatatataactttcaactcaccacaacttttgttaatagcctactgttggccagaagccttaccaataacataaacactcaacacatattttgtatgtgatttgtattgtatactgtattcttacaatgaagtaagctacagaaaagaaaaagtactaataaaatcataaggaagagaatgtattcactatcactaaatggaagtggatcatcataaaggttttcatccatatcatcttcacattgagtaggctgaagaagagaagaggttggtcctgccatctcaggaatggcagaggcagaaaaggtgggggagatgggaaggaaggcaggagacgcacacatgctgagaaattcatcgttatttctgtctgacatttttgctttttcatttctctaaatatgtttctttgtgataccaatcctccttccaccatttgctttagttttggtgcccgtaccatagaaaggtccatatggtaaaagaagtcacaagcagtcttgaataatcggaacccctctgccagattgtcgaatgtcaacttattttctggtactgcgtctacatccacttcttcatcatctggcactgattcgaaagcactcatctccatcaagtggtcttctgttaattcctctggtgtgatgtctattcactcttgaatttctccaagatccatatcctgaaagcctacattccccaccttttttgccacaggcacactctctttcatgatttccttgattggccctattgtaaatctggacacagttttctccagtaggaaggctgggcactgagagccttcgaaccttctgcttcaccttttgacatttagggcccaattttaatgcatttaaatgttgcctccactctgaaatgaacatgggacgtctgtaatgtgtgaaataggtgtgtctcacccccttcatgaatattcatagagccttctataacctgttgaatatgtacatttagccaaccctttcagcataacttcctgtctcacctttctgtccctggaagtgcctacttttggtctttgctggaggctagacttcccagcctgtcaagacagccaggctgcaggctgcaacctttctaagaaataacgcttttgggctggcccagtggctcatgcctgtaatcccagcactttgggaggctgagttgggtggatcacttgagaccaggagttcgagcccagcctggccaacatggtgaaaccccatctctacctagaaaaaaatacaaaaattagccaggtgtagtggcatgtgcctgtcttcccagctaaacgggtggctgaggcaggagaattgcttgaacctgcgaggcagaggttgcagtgaactgagattgcaccactgcactccagcctggatgatagagctagactctgtcagacaaaaaaaaaaaaaagagagaaagaaagaaagaaagaagaaagaaagaaagagaaagaaagaaagaaagaaagaaagaaagaaagaaagaaagaaagaaagaaagaaagaaagaaagaaagaaaataaggctcttggcctggcacagtggctcatgcctgtaatctcagcactttagaaggtcgaggtgggaggattgcttgagctcaagagttcgagaccagctgggcaagatagtgggacccctgtctctacaaaaacaagtttgaaaattagccaggcatggtggcacacacctgtagttccagctacttgggaggctgaggtgggggattgcttgagcctgggaggttgaggctgcagttagtcatgattgtgccactgtactttagcctctccaaatttgtagatctcataattttaagtcaccatcctccaccagtctttcgttttaagttgttgtataatgatatcagtttttcttgaatcatattagaatctatagatatgcttttcttatagatatcctgcacccacataaaagctgcattttctctatttctctgtccttccttccttccttctttcttcttcttctttcccccccacccccctacagagcctcgcttccaggctggagtgcagttgtgtgatcttaggcttacttcagcctccacctcctgggctcaagtgattctcctgcctcggtctcccaaagtgctgggattaaaggcatgagccactacattcagccaaaagctacattttcaagactagacaaaaaggtatttggcaaaaagagcaaagtttcatgtctgctagcatggctgcagtgatgacactgtgaatttccttttctttttttacaatggttcttacactggattaatttatcttgaaatggtgggcaaccgcagctgcagacctcagtctacagtacatatcaatcaatccacctttttcttgtactgtcaagacttttctctgctttttggcagcacttccagaatcactagtggcgcttcgtacgcgtctcgatgtcttcttcagatttatggtattgcactaaacatgaaaaatacatgagaaccacgagagattacttttcactgtgatacacaatctacaggagagacaagtgctcacacggagatggctagtgtcacatggcattttaagtggacactcgacacctgagctcactgcaatagtagcaggaggggcgacagaattactacagtagtacagtgggctcccattaatttatgcaattatgacttaatactgcatctttacatttgtttacatttctcttgactgaatggcaccatgtactgtgtttgtgtgcataacttttgataaattttaactgtttatagttgatttatgtatgttttatggtggtaaatgataaaaatatgctagtattttatgcattcatgacacacctttttcttaactttttcaatatttctaggctacaaggttcatctgcaagtttcttcaaatggttgcaatgcttactgcaacctccatctcctaggctcaagtgatcctcctgcctcagcctcccaaagtgctgggattacaagcatgagctactacatctgtccaaaagctgcatttccaagaccaggtaaaaaggtatttggccaaaagagcaaggtttcacgtctgctggcatggctgatgtgaaattttccaatacatttttccaatatatttactgaaaaaaaaaactgggccaggtgtggtggttcatgtctgtgatcccagcaatttgggaggccaaggttgggagggttacttgagtcctggagttcgagaccagcctgagcaacatagcgagaccccgtgtctctttttttttttttttttttttgagacagagtttcactcttgttgctcagactggagtgcagtggcatgatctcggctcactgcaacctccacctcccgggttcaagtgattctcctgcctcagacttctgagtagctgggaccacaggcacgtgccaccactcccagcttttttttttttttttttttttgtatttttagtagagacgaggtttcaccatgttggccaagttgttctcaatctcctgaccttgtgatctgcccatctcggcctcccaaagtgctgggattacaggcatgagccatcacacctggccaaccccgtgtctgtttaagaagatttaatttaaaaaaaaattttttaagaaaaaatctgtatgtaggtggatccatgtagttcagacttgtgttgttcaagggtcacaattgtatctgtggtgactgatacgaaacagatgaccaaaaaatgatagttttatttccccatctggtcccatttaaaagaggtgtttaggtctgagaattttcacacgtacaaggttccacagtcaggatgccaagaagctgcacccctcttgctggagtccagccctccccacccaaccctgctgactgctgatgcgccttccatccctgtcacaccgttgtctcgggaaggttgtgtgagtggagacacacagcatgggatctttgtaactggctgctttcgctaagcatcatgtttttcagatccaccccaatgctctgtgtgtcagtggcatgttcctttcaattgtggaatggtgtttgcctgcacagggagacacaggtagttacctcttcatccatgggaggacgtgcggttgtgtccagatttaggcgattatggatagagttgctgtaaacatttgtgcagaggttttcatgtgaacacaatttttccttactccagggaaaatcgttatgggactgctgggccatgtggtttaacacaactgtcagagtgctttccagtggcacctcactatggttttgatttgcatttccctaatgactagtgttgatggtctctcataggcttgctgtcttccacatacagcgtcctcttcggtgagggtccaagtcttttacccacttttgtttggatggttttctaactgttgattttgagagttcttcatatatgtcggactactttctttgttggatatgtggtttgtagatattctctcccagcctatagctgtcttttcagcatcttttaatagtctcttttgcaaagttatattttttattttgatcaagtctaattgatggatttttgcttttacatgcatttggcatcatgtctaagaacaatttccctaacctcaagtaatgaagacttcttcctatgttttcttccaaaactttaaacactctctctctctctcagcaaatacggaggaaacattcatgacaattgcaattctggtttctgtagctggtcacgtggtcctataactaccttcttccactccccagtctgtattccctttgccttcaggaagcctctgctggttgtggtttttaacctggtggggaaccttcattcccaaaggttctggacaattattaatcctgcctagattgggctgttgtgcttttctattgatcttaatcacagcgcatgccacgagggccctcctataccccagacatgctcttccccagtccattgtgaagcagcagggcagtttctccttggtggtctggaccagccacccccaccagcgtagttaactccttctttacctgttgatccagaggcatgaagagcttggcgccatcaggtggcagcctaaacttccagcgcaatggatcatccctgtgtctcttgggggcagcattcctccctctggaactaagatctctaggccagcagagcataaggtggtggggacaaggagcaaaacttttgctagtgggtcactaggggtgatggtgagtagtgctatgctaggagtcttggctatgggaggaatagcaccatgtattggacactgattccgagcatatccagccttctgagagccttgccccagccttgaaaggcactgccaccgagctgcactgtcactgagtcctccaaaggccattattccaccatctgtcaagccagctgcctcaggacagtgggagcctggaaggccagtgaattccatgaacattgggccatcgcggcatttcttttgctgtgatgtgagttccttaaccagaagaaatgctgtgtggataccatgacagtggagaaggcgttccgtaaacccacaggtggtagtttcagcagaagcactgtactcagggagggcaaatccatatgcaaagtgtgtattccacttagaacaaatactgcccgttccatggtggaaaaggtcgtaggtaatcaacctgtcactaagtggctggctgatcactctgggagatggtgtcatactggggactcagtgttggtctctgctgctggtagactggacatattggtggctgtagagagttcggccttggtgagtgtgagtccacaatcctgagcccatgcataacctcatccctgccaccatggccactttgtttctgagaccctggggtgatgacaggggtggctggggaaagagactgacatctacagaatgggtcatcttatttacctgttattaacgtcctgctctgctgaggtcacccttcagtgagcattcacataggcacacatatcatcacattttctgccccttcagtgaggtctatccacatacctcttccccaggcttgtctgtcacacatctacctatcatgttccctgcaagtccctaaccagccagccaaattattggccacaacccatgaattggtatatataatctcacgtctggccatttctccttccaagcaaactgcacaatcaggtacactgccccaagctctgcccatggggagggttactcttcacctttgtcctttagggatatcctagaagggggctgtcatgctgcagctgtctgctttcaggtggtacctgggtatcacacagaaccatctgtaagggccaagagaaggcctgagccttctctccctctgtcatctgatcctagagaactccccatgaggccattggtgcaggctgggagagagaaggcagtgtactaggggtggggaccatgggcatttgggccacttatgcagccgacttatgccttcagggcctgctggggcctgttcacacacagacccctttcctctgatgatggagcgctgccatgcatgcccacctcatgcttcatgggtcagataaaactcagttcatgttggtcagctcaggtcacatgggaacttggtgatccccagttaagcgttcagcctagtggcagatgaacagatgtttctcaaaaggaaaatagttctccctctccctctccctctccctctcccttccctctccgtctccgtctccccacggtctccctctccctctccctctttccacactctccctctgatgctgagcagaagctggactgtactgctgccatctcggttcactgcaacctccctgcctgattctcctgcctcagcctgccgagtgcctgcgattgcaggcgagcgccgccaagcctgactggttttcctatttttttggtggagacagggtttcgctgtgttggccgggctggtctccagctcctaaccgcgagtgatccgccagcctcagcctcccgaggtgccgggattgcagacggagtctggctcactcagtgctcaatggtgcccgggctggagtgcagtggcgtgatctcggctcgctacaacctccaccacccagccgcctgccttggcctcccaaagtgccgagattgcagcctctgcccagccgccaccccgtctgggaagtgaggagcgtctctgcctggccgcccatcatctgggacgtgaggagcccctctgcccggctgcccagtctggaaagtgaggagcgtctctgcccggccgcccatcgtctgagatgtggggagcgcctctgccccgccgccccatctgggatgtgaggagcgcctctaccccaccgcgaccccgtctgggaggtgaggagcatctctgcccagccgcccagtctgagaagtgaggagaccctccgcctggcaaccgccccatctgagaagtgaggagcccctccgcccggcagccaccccatctgggaagtgaggagcgtctccgcccggcagccaccccgtccgggagggaggtgggggtcagcccctgccaggccggccgccctgtccgggagggaggtgggggggtcagccccccgcccggcagccaccccgtccgggagggaggtggggggatcagccccccgcccagccagccaccccgtccgggaggtgaggggcgcctctgcccggccacccctactgggaagtgaggagcccctctgcccagccagccgccccgaccgggagggaggtgggggggtcagccccccgcccggccagccgccccgcccgggaggtgaggggcgcctctgcccggccacccctactgggaagtgaggagcccctctgcccggccaccaccccgtctgggaggtgtacccaacagctctttgagaacgggccatgatgacaatggcggttttgtggaatagaaaggggggaaaggtggggaaaacattgagaaatcggatggttgccgtgtctgtgtagaaagaggtagacatgggagtcttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcattaagagtcatcaccactccctaatctcaaatacccagggacacaaacactgcggaaggccgcagggtcctctgcctaggaaaaccagagacctttgttcacttgtttatctgctgaccttccctccactattgtcctatgaccctgccatatccccctctgtgagaaacacccaagaatgatcaataaaataaataaataaataaataaaaaggaaaatagttatctgctgaggatggcagggctgtgcaccaaaatcttaagggcctgtgctgcgactcacctataggcgcctgccaaaggctccaaacttatctgccactgatgcttcgagcaatattggatctgctgggtcacatggtccctgtggcagagtagcatgcacggacacctggacctgctgcacggccttctcttgttctcaacaccagcagcctttcaggtcacttgttacatgagctggagcaacacacccaaatgaggaatatgcttcatcaaaactccaaatagttcaacttgcattataattcagctagccacaggatgagattctgagtttgattttcagcaatctcagctgaggggctacctgggctaagggtttacttgagggcacacaaaggagttttcaggtcatttatgtgatacttgagttgggaattggaatccctgagctcattcttttatttcccctttgtctagtgacaatagaagcaaccatctagtattcattagtttgctgaaaatgtttgaaatgccctatacacagtcacccagatcctagcttcttataaagtggttgataggagtctccaatggtgatatttgtgtatctctattgccagattatgccatgaactatcagtgctctattattggaaatagagttattaacaactttaaatgaaatctgtttagagaaccaattccagaaaccccagaacaaacccagaacactcattctcaaaattctgttcctctagaaccattatctgtaccaaaatctgtattagtcagagtttttgagaaaaacagaaccaatatgatatataatgggctcacacaattatggaggctgagaagtccagttggcagcctggagacttgggagaaccaatgatgtagttctagtctgtgttggaaggcttgagaaccaggagaactgatggttgagttccagtccaaaagtcagcaggctcaagatccaagaatagcctatgtttcagtttaagtccaaagacaggaaaagaccaatgtcccctctcaagcagtcagacaagaggagtcccctcttgctcaggctttttgttgtattcaggtcttcacttggttgaattatcctgcccacattggacagaacaatctactttactcagttcaccaatccaaatactcatctcaaggagaaacaccccacagacaaacccagaaaatgtttagccaaatatctgggcaccctgtagcccagtcaagttgacacataaaattaacaatcacagctgttgtggaattaacctaaatgtctataacgaatgaataaagaaagtgtgtgagtgtgtgtgtgtgtgtgtgtgtgtgtgtgtatacatatatataaaatatacacaatggaatattatttaaccataaaaatgacatgctgtcatttaggcaatgtggatgagcctggaggaccttatgttaagcaaaataagtcagacacggaaagatgttctcattcatatgtgggagctagaaacattttgaactcatgaaagtagagagtagaattgtgggtattagaggctagaaagggtagagaggagagaaggctgggggaggctgggtaccataccaaattacagttagataggaggaatgagttctgttcagcaacactgtagggtgaatgtggttaacaataatttattgcatattttcaaaaagctaggagagaggattttgaatgttcacaaaacaaatgaaaatgtctgaggtgatggatatgttaattatcctcatttgatcatttacacattgtatgctcatatggaaatatcactctgtatcccataaacatatagaattattacatgtcaactaaaactaaaaggaaaaaattaactatcacagagatgagccagaagctcataaacacctttttgaagtcactgtcctgaactcctcacatgctatgatttccctggtactttccagctcctaggagctctccttttcagcgctccagctgagcaagggtattatttacttcactctgcaccttgcttgtcatgaccatgcccacatccagcgtcaagcaataaaaggacagaaagagtaaaaaagcaatggagtgcacccacctgcttagaccatctctctagttatcaggaagtgaggtgccagtgggctgcaggggactggggcataagaaaatggagtaaagagaaaagagtttcttgcactctctctgcatgttaggagactgtttcctgctcctcagccagatcaggaaggcttctcctgagccctctctgtttgcacccaagtccacttccaagttcaggcgtccttgaagacagactaagagacaccaaagaagggaaatggtaaaactcaatgccagatcagtgttactttgaattatggtgttttgttttgttttgtttcccaattctcctggggttatttggttttaaaactcttcaaatagcttctttatgtattctctctgatttagtgggagggacacagtgaaacgtgcttactccattttccccaaaactgaaattcccttaatttttttgaaactaaaaatgaattcctacaaacatatgaattttttttaatgctcattgttttgaaataattatagattcacaggcagttgtgcaggagtgtacaggaaggttccttgtgccctttacccaactgccccagggctagcatctgacataactacaatatcaaaacaggaaactgacattggtacgatccacagagcttactaatattcaacgaggtagtgatgtgctcacttgggtatgcgtgcatatagctgtctgtaatgttatcaagtatgtacttgtacctatcatcacaatcaggatgcatacctctgcaccacaggcttccttatggtaccactttagaggcacacatccacacgtccttcactccatccctaacccctggcaactattaatcttctcttcatctcagtaattatgttatttcacaaatgctatatacgtggaatcatatagtatgtacctttttaaaactgacttactttttaagattgataatttatttgaggttcattcaagttgttacatgtatcagtagtttgttctttgtaatgctgggtaatattccataatatggatgtaccacaatgtatccaatcattcaccattaaaggacatctgggtagttttcagtttggggttattacaaataaagctgctatgaacatttgaatataaaattctgtctaaaaacaagtttttatttctgtactagaaatgcccatgtttgcattttcttggtcctatggtaagtacattttcagttttataaggaactgccaaactttttccagagtggctgtaccattttacattttcaccagcaagtgtgggtgctctggtttctctgcttccttgccaggatttgctgttattctgttgttgttgttgttgttgttgttgttgttgttgttgttgttgttgttggagtctccatcgcccaggctgaagtgcagtggtgtgatctcagttcactgcaacctccacctcctggtttcaagcaattctcctgcctcagcctcccaagtagttggttacaggctcataccaccacggccggctaacttttgtatttttagtagagatggggtttcaccctgttggccatgctggtctcaaactcctgatctcaaatgatccactcgcctcggcctcccaaaattctgggattacaagcctgagctactgcacccagcctagtgctaatcactttttaaaaagccattctaatatgtagtgatgtctcattgtggttttaatttgaactttcctgatggctaatgttgctgaccatcctttcatttacaaagaatattttctttggtcaaatatctgttcatgtcatttgcacatttttaatttgattacttatttattttatgttgagttctgagagttctttattcttgacacaagttctttgtcagatatgtgatttgcaaatattttctctcattctgtaacttatctttccatcatcccaacagggtcttttgcagagcaaaaaaaatttaattttgatgaggtccaatttatccattttttttcttttatgaattgtattttgatgtcaagtctaagagctctgcctagttcctggtcctgaagattttcttctatttttttcctgaaaatattacagtttgacattaagcccatgatccttgtgttatgttttgtataaaatgtgaaggtcgggccaagcctcatctctttgcctatggatgtctgattgttcctgcagcacttgttgaaagggctatcactcctctactaaactgctgttgcatttttctcaaaaattaattaagcatatttctgggtggggggtctctgttctgcaccagtaattaatgtgtctatccctccaccagcaccatactgagttgatcactgtagttatagagtaagctttaatacttggtacagtgatttcttccatttaattattctttttcaaaattgtttcagctaacctagggccactcccttttaatataaagtttacaataagtttgcatatgtatacaaaaaacaatgccaagatttagaattgtattaaacctgcaatttgggggaagctgacatctatgttgagacttcccatccctaaatatggcatgactctccatttatgtagatatttgatttctttcagcagaattttgtaatttgcactatattctcctgtatatgttttattagatttatacctacatattaatacttcatgtatttcgagcagttgtaaatggtattgcagtttttattttggtttccacttgtttattgttaccatagagagatgcaatttgtgtacgtgtgttattcttgtgtattgcagccttgatattctcactctttatatcaaggatgttttgtttattccgtgggactgtttatgtagatgattatgccacgtgcaagtagtgataattttctttctttcttttcaatctgtgtactttttatttctttttctggtcttattacactggctagaacttctagtactatcttgaattaaaatggtgaaagggaacattcctgccttgttcctgctcttaaggggaaagcattcattctttcaccattaagtgtgatgttaactgtagatttttgcaaatgctgtttatgaagttggaggaaattaccctctattccaagtttgctaagagtttatatcataaatgggttttgaattttgtcaaaaccttttcctatgtcaattgataagatcatatgatttttcttcttcagtttacaaggcagaatatgttgattggcttttcaaatattaaaacagtcttgcataacttgagtgaaattcctcttgattgtggtctactactctttttatgcattactaaatttgatttgctaacattgtcttgaggatttttccatctaagcttatgagccaaatcagcctgcagtgttctttcctctgtcccttcctccttcctccctcccttccttcctttgtgctgtctttgttttgttttgatatcaaaataatgatatcatagtcctttctcttctattttctggaagagattgtgtaaaactggtgttgattcttctttaaatatttggtaaatactccagtgaaaccatttgggtctggatacattgtgttcaggagctttttagttacaaatccaatttatataatggttataggactattcaggcttttatatatttcatcttttctgagttgtggtaatttgtgattttcaaggaattgatccattttttcctaggctgtcaaatgtatgagcataaaatttttatagcatttttcatagatgcagcctcttttgtgatatttcttgtttcattcctgatattggtgatttgtgtgttatctcctttcatctttgttgatcatgctagaggattatcagttttattaatttttttaagaacctgttttttatttccttaatgttctgcattgctttcctgtttttaatttcatcaatttctgctcttcactttccgtcctatttgccttaactttattttactattcctcttttagttttttgactactggtttgagaactttccatattactaaggaaataatataaggatttagtgctataaatttctctctcagctctgctatagctgaatccctcaattttttttttaagacagggtctcattctgtcaccgaagctggactgcagtagcacaatctccacttactgcagcctcaaccttctgggctcaagcaatccccccatctcagcctcccaagtaactgggactacaggtgcatgccaccacacctggctaattttttgcagagatagggatttcaccatgttgcccaggctagtcttgaactcctgggctgaagaagtgatccacccgccacagcctcccaaagtactgggattataggagtaagccattgcacccagccgcatccacaaattttgatatgccatattttcattgtgttacttgcgttttaaaaattccctttgagacttcttcttgtccacattgtatataaatgtttactgcttaatttccaagtgtttgcagatttttctcctgtctttctgcaatttatttctagtttgattccattgtggtcagaggacactctttgtatgatttcggtttttaaaaatttattaaggtttgttttaagatctagagtctgttctataagagcttgaaaataatgcgtattttgctgttgatggatagagttttccataaatgttaattataccctattggctaataatattgttcagttatcctatattcttgctgatttttttgtctagtaattttacaaattctgaaagtgagatgttgacatatcccaactataattatggatttttctatttcttttttaagctctatcaggttttgcttcatgtgttttgaagctgtgttgtttggtgcacatatatttaggatcaagatatactcttgctcttttgttattatgtaatattcctcttttgtcctagaaattctttttgccatgaactctatctgatattattatagcatctcctgcttttttgaaagttcctgtttgtttgcatgaaatatttttttttctgttctttcacttccaatctgttaaatacctatgccatggtattagaactgaatatcttatggacatcctataatgggtcatatttttgcatttactctgctatttctgtgtttttcccagatttaaccaaactgcaaagtctgagggcatggttcctaaaatttccctcattcctgacaccaacagcaagttttggaggtttccaaagcaccttaagtttcaatcatttgctggaaggactcattgaaaactgctctacatgtggttactgtttactgcagggaaatgatacaaatcagaaccagcacagagggcagggctaggagggtctgtgaagcctctgttgtcctcaggtgcattactctcccagcatccacgtgtgacaataccatgaagcactgccaacctaggaacctcacccaagccttggtgtccagagtgtttcctggaagtgcattgtgcagccataattgacagatctgttggagactggttggaactctgtcttcacctctccctttcccggaatctggggctgacagcacattcctaggggggcccaccatgagccagctggtagcataaacttcaggtatggtctgaggggcccactatgaatagcaaagacccttctgtcacatgggcttcaggactacttaccaggagccaggacaaaggctagacctctctttgggctaggccaaattctttaccacacagaaattatatttaggactcaaatgtgccatttttatttgctttctgcatgtttcttatgtttcctttatcctgttttgtttcacttgtcatggattagttgaacagtttttagcatttcattttgaattatttattcttttgggtgcattgctttgtatcgttttctaagtggctgctctaggattgattataatatacacatgtaacttatcacagcctgctggcatcaatgtttcaccatttcatgagaaatatcaaaagcttacttttatttccccttttcctcccccacttaaacatgtaattatcataaatatttcctcttcagatgtagagcaccgcagcagatgatgttattattttttgcttcaaccataaaatacaatttaagaaactcatcatagtctattatatttaccacatgattaccccttctgttgttgctatttctgatttccttatttcctttttgttaggagagcttccttcagccatttattaagggtgggttttctggtaacaaattatcctagttgtccttcctcttagaatgtctttatttccccctcatccctgaaggatacgttcactgaatagggttctgggcagacagtttttctcagcacctggcgatggtgtgttgcccccctctacctcgtggttttagagaagcccaccatcctcagaaccagtgtatcttaatgcatcatttttctctggtggtttaaaaaatttttttctttgtctttcctttcctgaagttccattatgatgtgtttatcctatttggggtttgctcagattcttgaatctgcaggtttatttctttcaccaaatttgggacgtcttcaaccactgtgcctttgaatactttttcaccacacattccttcctctcctcctgggactctggtgacaggaacgctgggccttttgtcactgtcccacccatccccaaggaggcattcatttctcagtctcctatctctccgttgttcctatgggccagctctattaattgtctttgaatcaacagactctgttctctgtcgcctccactctgctattgaacccaactgcacattttttcatttagttattgtatttttcagttgtatgattttcattttgttcttgtttcaagaaaattcaccattgttttctgaagcatttttatgatggctgctttaaagttctaatatctgatttatcttgattaatcttattttgctatttaagttgttttttgttttgttctgttatgtttttgagacagagtcttactctgatgctcagactggtgtgcagtagcatgatctcagctcactgcagcctcaaactgccgggctcaagcggtcctcctgcttcagcctcctaagtagctggcaccacaggtgtgtgccaccacagctggctaacttttaaattgtttgtagagacaggatcatgctgtgttgcccaggctgatctcaaactcctggactcaagccatcctcctgattgaccttccaaagtgctgggattacaggtgggagccccctcacctggcttcaagttgctttttatgtttcctgatgtgacaaataatttcaaatatattctggagatttcggttattatgtaaggaaactttttatcctatttgaacattccagttcagtccatggtacccttatttggtttaccatataggccccagcctgctttaggggaaatgtagagtcaatgacaatttggttttcaaagccctccccgtgctattctggtcgggtttgttcttctggatctgctgggcctctggttcaatccctgcgcatgttgccggggttgccctgtgcggtgggggtaggttaaggaaacgctgggtgctgggtgtggtctctgagccacggtcagcagagcctgttgtggcctgggtgtgatgctgagggccaggcctgaacggagctgctgtgacatggatcagggggaatctcctcgctgggtctccagtgagatgcccttttcagtcctttcaccagagagaacaggctctttttcttttcttttttccccctgcaggttttggcagttacaggttgcagggttctctgggcccatccaggagatgagagagaaaaagaaaactcagggcctggtacagcgtcacccccaaagtcccaaggttcctggacagcctttcttcctctccatctcctagagtcctcttacgtctgttaaattatttccagggtgtctagttgtatttagagggcagatgccacctcgtcatagaacaccagggtccactctccaggcatttggaaagagttgccacgaggtcctcggaagggtgtgacagttcacacgcccaccagcagcgtttccacgtctccatttcctctgcccctgacagcatctaatgctatgatttttgtttgaaaatttggcttttggttcctttatgaggtgattaattaatacaggctgctggctccttcccatgaatccaaaccttggagatgccatcaaagggatgacagttgatggagcccagaacctaagaggaaacccctgagagcctcgcagaggctgggcaaatgtggtggagtctggggcaggaggggaaccacagtctgagtggaggaggccacacagcacagcccgggccagtctgcagctctctgctccggggcccacctggggctgtcatctgccggccctgctttcctgtagaagatcccacccataccagccccaggaatccaggcaaggccagagcacctcaggagcctcctggagtgatggccatgacacctggtcaagctggctggtagcccctgggcagccctcctccccagcccaaggacagccaattacagcacagggcagccctggacagacagcaccagctagaaggacggggcattccctgcagaccagagcagcccccggggatgagcaaagagggccccagtcatcctgccagaggctctgccccgaggagcccctgcctgcctccctgaaacccaccaggaaggtgtcaactggggcctaggacgaaggcagctgaccgtccccagggaacagagagcggcctgaggaaacgagacagccaggggagtgaactctgggagggaaaaaccgcaaggtttttccttggaggagggagcagatgagcgggtaagaccggcaaatccgtcacataccctcaggacgcagggagcgcggctggaatcagcagttatgcagaaaacgcaggccaggttactggactggaacatgcgggcgcttaagtgatgaacttggtgggaagtttggagagcagaaaatgaacgagtgagacaagtcaggctctgagctcttttagaaggatctgaagggattgaggaggcagaggtgagggaggagaaatattcagtgcttagaagaggaaaaatgaatagataagaggaggtatctgaaaaatgactaggaacttcccccaattaagaaaagacgcacatcctcaaactgaaaaggcctgcagagcgttaattacattttaaagttaaaatgttctgtgtaatttcaaagaaaagcatctacattttgagtcaaaattgctaaaaacttccaaagagaaaaagcaggtaaccctcacaggaacgcgagtggtgctgacattagaattgcagcacagacaacggatgcaaaaagaaagggggtgacagcttcagacgcgagaggaaaggaccctggaacccagggctgcgtcctgctcaccgccatgaaatatgggcacgcaggaagccatcctcagtcctatcagcccccttgagagtcaaccccaaaaacactcttggagaaatatttcagcaagaaaaaggagccagggagaatgctgccaggtctggggaggagtggtgcttcccgagcgtgaatggttcactgccatctaagtaagcaatgacctacgcgtgtgccgcacagtccagcttcctcagaggcggtggtggcctggtggaggaatgtgggctggctgggtggccacagagaattactgtttccattaaaaggaaatgtgttctggccgggagccgtggctcacgctgtaatcccagcaccttgagaggctcaggcaggtggatcacttgaggtcaggagttcgagaccagcctggccaacctggtaaaaccccgtctctactaaaaatacaaaacttagctgggcgtggtggcaggcgcctgtaatcccagcactttggaaggcggaggcgggcggatcacttgaggctaggagttagagaccagcctgaccaacatggggaaaccccgtgtctactaaaaatacaaaaattagcctggcatggtggcacatgcctgtagtcccagctactcgggaggctgaggcaggagaatcgcttgaacctgggaggtggtatgttgcagtgagcggagatcacgccactgcactccagcctgggcaacagagcaaaaacctgcctaaaaaaaaaaaaagtatcacatggagacgtgtgtccgtttgggactgttttccagcctttccacactctctccctccccatctgtccctccatctccaccaagctgtgttttgatgttgtgtttgcatgatttggtgtatctggcattttaacatttgcagggcaaatttctcttcattttgggtttttctctgcctgttcttttgtgtttattctttcagataaacttaattctttttcctttaatgtcctctgataaaaatatgcttcagagaccactgcatgtcactgggttatcagttttaatagctgcaaaaattacatggagtgcttagaccatcatttatttaaggagtctattttggttgttttcacttttcccccatgcccagtggcgatggcttttgtgcagtgtagaggttgaaagaaagggagttccactgcttaaactcaaaatgtgtttctactatagtgggccctccctacctatgggttccaattcatggattcaaccaaccatcagttgaaaatattcagaaaaagaagtggatggttctgtctgtactgaacatgtacagacttttttccttcctgttagtccctaacagtataacacctgtttccatagcatttacagtatacgaggtattacaggtaacttagagatggtttcagctctacaggaggatgtgcgcaggttacatacagatactatgtcatgcacaaggacttgagcttcggtggattttcatatcttcaggggtcctggaaccaatcccctacagaatcctagggatgaatgtatttgccagtcctgtgacttggaccaggcatttaatctttcccagcctccatttgctaatctttataatggtgataagtgttaaacccttcactgtttcagtggggcacatcccagcacacgctggtgaccacttttctggagtagattatttgaagcaggattggaatcatcagtcagggagtaggtacatttcccctccacatttgcaagtcacttcgtgttcctaaacggttgtaccagatcccatgtcctcccacagggcaggaagtgcccatctcctgactccactggtggtgaaggggctcagggcttttcatcttgccagtctggtgagcacaaggcgcttttcattattgtttacatttgcatttttattagacagcaggagggttttagcatctcttcaagtgtttattggccattctcctgtctcctgcaatttgtgccaatcctctgcccatttttctgttgggttggttgcctttcacatattgattttgtaaaagctctttatatattctccatttaaatcccgtggctgcttataaatgttataaaagacttttccctggtatgatgcttaccttttgacgtgtccatgaggcctttctgtattcagaggttttcaatactcgtataatcaaacctggtagttttccttttggttttgaggttgtgtcttgtttgggtgagtctttcctacccctttgactacagaaatgccctttcatttataatatcctcctattatgaaacatatttccacattttctaaatttttaatttttagctgagaaataaattagtaatgattaaagtattaattacttttatcttgttattaattattggttttatttatttacatgtagttggcttacatttagtttagtttaacttaattactttaaagtaatgtataaatatcttcagtttgtaccgcatgttctcactcataagtgggagttgaacaatgagaacacatagacacagggaggggaacatcacacatcagagtctatccgggggctgggtgcaagggaaaggagagcatcaggacaaatacctaatgcatgcagggcttaaaacctagatgacaagttgataggtgcagcacatgtatacctatgtaataaacctacatgttctgcacatgtatcccagaacttaaagtaaatttttaaaaaaattaattaattaaaaatatatatcttcagtttgtaaatgtcccggcaacacgggaacagagttaaaagagtgtgtgtcgtccttagctgctcccaccccctcatctcctccctagccatcccagccaccagtctggcctgcgcctttcaggtttcttcctagacgctggcatacatagatcactattttctgccatgtggtatcttttaaacacacacgattgttttgtgcagaaactttctatttttacctctcataagtgtcctgtgggttctttccatgtcactgtgatgtgtgtgcgtatgtgagattcaagttcagcttgctaatcttgtagaaagaattacgctccacttcccctgtgctctggccctccctaacacagcagcccatccctggaggctgatggagcccctcgagcacttctgcttaccatttctctttgttctgtttgttcaggttttctgcctcctgctaagccaatttatacattccaagaaaatcttccatttcatccaggtgaaacagaacctactggaatgaagctggcctcccgtctccttgatttgaagcagcttctccacattggttattatgccatttttctaaatctaacgttttaaaatttgtgcctttcctttctcttttgcttgacttcccagaggtttttttaaccgtcttttcaaagaagtggttttgggttttatttatcaagtctacttttattatggctgttttaaaattaaatatatttatttcttgtttcccttaaaaaagcttcttgtatgtttacttagtttatataattttatatgtcttttgttgaagcatattaacaaacacttgcagctataacatttcccctgggaactgctttggacatatccaaagattttgataagtcacacacttattgtagtttgtttctgaaaagtttttcattttagtttttattttctcttttattcaaattatcatgcgctttctccttttatcctgtttctgacaaattaatctaaggatataaatctctccctaaatgtcaattttgttgagtttcataattttaatatgtaataccctattgctattgagttccaggcattttataattttcattgtgaaaactaactttgtttccaaaacacactttttcttttttttgagacagagtctcactctgtcgctcaggatggagtgcaatagcacaatctcagctcgctgcaacctctgcctcctaagtttaggtgattttgttgcctcagcctccctagtagctgggtttacaggctcttgccactatgcctggctaattttttgtatttttagtagagacagggtttcgtcatgttgcccaggctggtcttgatctcctgaccttgggtgatccacctgcttcagcctctcaaagtgctgggattacaggcatgagccaccatgcctggccccaaaatgcacttttaacatggtctttgttactgcatgtttctaattttgttgctccctggtgagagaatgtgatttgtataacagcaattctgggaaaggggctgaagcttcctgctcctttagcacagctaattttcccaaacgctgtccatgagcttggaaagagcattgtactctgttgggatgggctcaaatctctctgtaaaaatgagtgttcttctgttgttattgttttggtttttgtttgttttgttttgttttttgtctcacttgttttgtttgctcagatcttttgatgatctggataatcttttaatttatgcaggatgtttctctgcttgtgcaggctggtgggatgggggactggatagaggacaggtgtctgcttgcccaggactggcaaactgtcacttgccctggttgtgccttgccaggagctcccgtgcctgtctctgagagtgtcatgagctcagtggtggtagttgtgtggtggatgcacttccccctgggttggggggtgggtggctggtcctaactgtttgttgttgcagatgagacacgggcgcacttctgcttcctgatggatcttgtcagtcgtttgacttcttcctggtctgggctcctgagttggccctctgcaggccaagcaggaatggagctggctgctacaagagttccttcactagagggcatctctcctctctcctcccacacatgggaacacgcgggtgggctttcctccgcccactgtggtccacagcccggctttccactcctcaccctctgctctcagacagacctgcttttccctggtgtctgtgagaggtgattcttcattgtgccaagaatgtggatttttttgagagcagggactctcacagatatttgcacacccatgttcaaagcagcatgattcacaagagtcaaaaggtagaagcattctgagggtctatgggtgagtggatggacaagcgaaatgtggttatgcatacagtagactgttactgaacctttagcaggaaggagattctttttttttctttctttttgtggagaatggggtctcgctatattgcccaggcaggtctcgaactcctgggttcaagctatcttcccacctctgcctccctaacagctgggataataggcatgagcctataatatcacccggccaggagggaaattctgagaggcatgccaacacgcatgagccttgaggacattgtgctagatggaataagccaaccacaaaaggacagatacattgcgatttcacttacatgaggggcccagaatgggcaaattcagagacagaaagagcaatggtaacaaaaggagggagctggtgttcaatgggttcaatgctcagtggtgttcaatgggtatggtttccttttgggaagatgaaaaggttctggagatggacggtggtaggggatatgcgaaaatgtgagtgcacttaatgccagttaacccacactaaaagatggtacaactgtgcattttatgttaggtatattttcaccacaattaaaaaatttgaaaagagcttggattttggagctgatctgcctgtttcagatcctgccatgaagttctacgagcttgagccagttcctgggcctcctggtgcctcagtcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcagtctaccgggagaggccaggccaagcgcttgttcacccgcagccctcttagggaactttcacatgcttctcccactaggcctaggcacccctccccaccctccctgccctcctggttccctgatcctcagtgaccttgtccttcaagactgaactccagagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcgggtcaggcgtagggtgggcccgctgccctcacacccgccccggccgcacacaggaggcgcgatcagcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccaggctcgagggagagggagtgtgcgtgcgtgtgaacgcgtcacactcttgtgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgtttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtgtgtttgcatgaacacatctgtgtatgcacgagtgtgtgcacatctgtatgtggctgtgtaagtccgtatgtacatttgtgtgcatgtctgtgtgtgcatatgtttgtacgtgtgtgtgctgtgcatgtgtgtgttaaggccctggggtggagctgagttgttgaggggagatgctgggagggcagccagcaccaggtgtttgttggccaggagagaagctgccatccaggtgcactctggggctcctgcttcagtggcacaaggcttcgggattgaggaagctgggggctggagcagggcagtcctgcacctcatgggaggtgcagagtgaggtcaggaggatggagagagtgccagagaatggggggaatctgaggcatcaggaaaggaagacacaggccacggagagggcagctgggccctgggtgaggccggccctcaggaaggaggtgccacaggtaggggagtgcccagatggagagcccaggggtatggacccacgggtgtatgacagtgggggtactcctgaaaccgcagtattatccaacaagcagggttgggacaactagttatttcatttaaaaaaacaggtcaatgtcagtcctcattctatgctttaaaataagctccagatggactcatgctttacatgtaaagaagaaaaggcaaaaagaaaataaagaaaaggcttgtaagcaggtagttaattgggggcaatcccaggatgcaggagagaggggatggagccacagcaggtctggggaagggagaaaagccggccccgagaccagggcccaaggacccattcaggccagcagtgccttctgtgcacttccgcaaggtcacacgttcttccaaagttgccatcatggagaggtaggcttccacgtagtcttgactccactcgatttcaatccttgggtggcttttcctgtgatcacactcagccctgatacagccattgctggggcctcccctggctggacgttccgcttttggtccacattctttcctcctgccctgaggctggccatgggcctcctgaaggctagctgggaggacctcccttccatggctgtgctcttgctctgcccacgctgtcgcctccatctctacctccctttccatcctcaccaccagcgctcgagtcagtggggagcttttcactcaccaagcccaggcaggtgcgtcacgtgaatttctcttgagcctcccactagaggtagtggcactgttgtcaccctatctgctgaggatatgctggggctggcaggggctacccaagaccaaaggtgtcgctgtctccatcctgtgcccacccagccctgccccctgggatcccttcaaatctttttttttttttttttttttgagatggagtcctgctctgtctcccagcctggagtgcagtggcgtgatctcagctcactgcaatctccgcctcccgggttcaagcgattctcctgcctcagcctcacaagtagctgggactacaggcacccaccaccacacccggctaattttttttttttttttttgtattttagtagagacggggtttcactatgttggccaggctggtcttgaactcctgacctcatgatccccctgccacagcctcccaaagtgctgggattacaggcatgagccaccacacctggcccccttcaaatcttaacagagaagccaccaaagtctccttgggtccatcacatggatggacctcctgggcccttcagcccctgggcttcccttgaggtcctggagctatgtgggctccagctctgggaaggtggacccccacgtgtgtgtcctgccgtcactgtctctaaggagtctggctcacactaagtgagccataaggccttgttcaaggtcatctgtcccactgatttcagacgcatggtggagtctgaaatcatctgtcccccacagtgcattcagagccctgtctggactagggcacacacacatgcatgctcatatatgcatatgcacatacgcacacacatatgcatatgcacatacgcacacacatatgcatatgcacatacgcacacacatatgcatatgcacatacgcacacacatatgcatatgcacatatgcacacacatatgcatatgcacacacatgcaaggctgcaaggctcatgcacacacacacatgcacacacatgcacacacatgcacatgcacacacatgcacatgcatgctcacatgtacaggcactcatgcacctagagccttctcatccttcactttgagtcccccctccccttgcccatccttgcccatccttcaagggctcagtcaaaagccatcttttacaaattgtctctggttgactttcttttttttcccctcttagaagaagcgatgctgtcctcagtcatcgagcattcactgggcgcttcatgtgtgccaggccccgacatgggtcttgggcatgttccagttctcatgtcctcagggctccttggtgagtcgagggtgaggaggacacggaggcacaggaggccacggggcaggtctaggtccactcagcctccagagttcagccctccctgctgagtcggggtgagcaggacagatgcctgctcctggaacttggtgggtgaggtggacaggcatgcagggaggcgccaggctcaggggctgtggaacagagaaaggaagcttccaggacatcaaacaattcctggagtgccagggcaagaggggaatctgggtggaggaaaacgtgaacagggcagaggttggaggtggatgtggcccccgagcacgttggaggcgactgaggtgcttcttgactttgggcatcttcgttcatccctgcatttgcacatttgttgaacacacctactgagacacttgttttctttccatggtccatacattaggaacatagagttagcttcctggggaactttttaagaagtattcttagagaagaaaccaggaggcatcgttgtgggatgttggtccaggatcttgggtgtgtcctttggtcttttgtgggtcaggttagcaggaattgtgtcctgaggtgttgggactgcaaagtacaggttccctcctgcccacactgatgccttcagggaatgacctgtctgctcttctaagaagaacacttaactcagccttggctgacctcagctacctgtgctttcttcagccaggctctgtgttttgtgcttttactctcaaaacaaccctattattatccctgtcccacagacgagatgctgagcccctgagaggctcagtaggtgcctgaaggtcttccagccaggaggtggcagagccagggccggcctggcctgaggactccgaagctcccatgggcacagctccttcatgccagctctgtgttgggattttctgtggttgtcacagccatcttcctggtcagctaagttacagacagggtgaaactaggatggccgagctggaaccagagctcattcctgagcagggcacctgggccctgcctacggtgctgggcaggctcctggtgtggaggtcaggctcagatcctgcagtccctgtggccgtggggcttttctaggcaccctcctgactgctaacaccaggagggcctatgatatgggaccgctgccccatgacgtgtgccaggtttctgcacgtgaccactgggaaaggctggccctgggctgggtggatccgcactgcctgctggcccctgcacccagatggtgcagcccacacccctctgatgcccacccacgcccggctctgggacttccctccttccgctgtgtctgaccctggttgcccttgttctgccactggcttgtagcagcccttccggaagccatgtcctccagggagatttgattatgtcctggtggtgcgacctcgctaatgcaatcaggaagttttctcaagacttcagctgctttgttggcagccaggcctggctctcagcagctctgcaggctggaagggcccaagagacccttcacccacccggtgtctccagcagcagggaggggtccggggcacagcctattgctgctctgctctcctcccttcttggggtaagctcctttgctctgattttatttggaatcatcgagagcctctatctgtctagaaaaagcgcttagcaatgaggaatcagcactgcagagaatactccagaaagcagccattttccatcaagattaggctcttaattgaaaattttaagaggagaggaaattaggggagaatccagatattctctccattatggtaatcagctgtaatcagagcctgagagctgtactcaatcccgggggttctcccaggattaccagagctgccacagtcaccttcaccgacctgcactggagtcagtgggaggggctggcggggtcaggggcactctggcaagtggatccaggagggctgggctggatccagggggctgagttcagagggaactctgcttagcaagtgtgaaacacaggactgggccttccaggcagagggaagattgagaactgcggctgagcgagtgcgtccaggggccccagtttagttgagggtctaagttttcccagcagggcaaggttgagggtgaggatgctgcaggccagttttctatggcctcagagtgaggacaagaagggggagatgggccacagggatgagggtgcctgctccctgcagcagggtgcacatcatggctgtgcagaggcagcaggcggcaggtattaggaagaagcccttcccgtgtgtgtcctaggggctgggcacaggctgggcacaaccctttgctcacggttgcagaagcccatccacatggggtcctgctgaactggcttcgtggggctgggaaggactggcctggcctctttgctcacttcaccttatgggcagtgtcctgcaggtttctgtgagcagagcagacagaaaggagatgcccagtgacgccagctgtcccccgcagagcttcctggagcctgggctctaggctgagggtccttgaacagacgtcatctccctggcttcagcagaatcacccacaaacccaccctgtgcccaccctcccatcacagagagcagctgctggagaacaaggcatgagactttggagacctggaggagcaggagacacaggagacaatggccagggtggtcatggtggcacggctatgccatcactgatttctgcccacccgccccctaagtctcacttgctgctactctcaatttcctacttaatgcttcggagagcaccagtcctgagatgagaggcgggatgttcactctctgggagttgagatggaacccaggcagttagaaaaaagtgccacaaccacgtgccggacctactacttgccaggagcttcgtgagtcatccaattcctaaaacaattgtgctgcgtatgctccaccacgcctgggcgactcggggaaatggggctgcgggaggctcagtgacctgccctgggtgacacggatagcgtggatgccctgtccatgcatggggctgtgctaggaggacaggaccatccccggaagctggtcctgtgtccactgctcacggtggcagctgcttgggctgacaaccgcccctccctcctgctggtgagtccttggatgtattcaggcacatggcagcaaggtctcctgtgtcccagaggcgactaggacccacaagtgagcagcaggtgccccactccttcatgctaaggctcatcacgggacgaaacccaaggtggtattggagccaggggctgtggccatgacagccacccactccagacgatatccacattcggaatagttcagagtggcctgccttgatgacatcacgaacttctccatggaaatgtgtcacagaaccagaacttaagggcatttggatgaggttgaggtgagatcaggtcacagaagaacgttctcaagttaggtgggaaacagctggagactctgggatgtcctcaggacctttatctaagcaaacacatgataaggtctttcccaagaaataagcgtggctttttgtcctggttgaggagggttgttgtggatcttttcccccttttaccttggcttccaggaagctcagtgccaagttttatgctccacccaggcctactatccttggactggtcctcaggtgcagcccttggtctctcctttctttatcgcatgagcccgcttggtttctgtacattttgtccgctggtgctgacggctggacaccctttcctgaaggagatggggcatagagtgagtggatgatgatgggctgtgacagggcccactaccaaggatgtgggctacgaggtgtgggctgggaaggaggaggaggaccctgcacctcagggggcaaccaggagcacattctggggagcacacacctgcggtgttatcacggccactgcccatgtcttggacactggaataaacaggatgtggcgaagccttctgtgtatgggggaagacttccttactcgccactgctgtcacgctctatggccatcttgacccatcactcaggcaacatcagacgcgtctctctgttcaagggctctgcccctaaccttgtgccagaaagaggcttgacagtttgtcctgtctcgaggtttcctctatatctcttgctggggctcccatagactgttctgatttttactgatgaagacagtgccatggtgagcctagcagtgcacacagctcttctctttcccaatcatttccatgggcgaacccctgagtgtagaatgaccactccagtcagattgtgaatacagtgaactgtgggccatgggctcccaggacactgctccggcctggctcctgcacccagactcattgctgttggctttgccatggtaacactagtttggtataaaactgcaccgtctccttctgtctgagtttccttgactgctgtggtggttgagcagttcgccctactttgggttttggtcttggtttcgttgcttttagtatttcacccatgaaagatctattcatacccatcacgcatctatctatccagaatttgaattcgttaaaatgcaagggaatttttaatatataataatgttagcaattggtctgtcatatttgatacaagcatctttctggcctgtttccatcttacttttgtttctttttcatccactcataagttcagactgttttctagtcagtcacggccctggttccactaaggaggggaatgtcccttgagtccccggctggcctccctgggagagtgccacacccccacccgagtccagaggctcaggagctgctctggctgcacgtgttccccgggacaggtcttgggcactggggggtctgtgcctggacactggcattttgcttcattcccactcagggcccctccgcagcaggcttggtagctgggggtggccggacacctggagaagggctgggggcactgcaccagtctcccaggctggaggggccacagtagggagttcccagctcagccccaggggatggccacccctgaatcctcaccgaaggcatccaggctgtcccagatcctgcccacacctgagacctcggctcccgcttctctccgcaggcaggcagagcaggcggcgggatgtgtgggttgaaccctgatggcaatgggaagggtcttcgtgacacagcttcccagcacccaggcagagacaggaggctgggctgctaacccgactggaggctgtgctcacccagtcccctccctgtgcttctggggtctccagaccaccccacagggtacccagatcagtgtgggctcagccccctgcccactgcaccctccttcggggtgccttcctcgtctgtcatgatgttcctgatcctgcacccgtcccctcttcctccagccttccctggctggctgctgtagtcagtctctagggctctgcacagcacttcctggtggtgcatcctggaggacttcccggtagaggtgtctggcaggcacaagcttgctgtgtgcctggcctgcagaaatgcacggtaggcatgcatttgttggatggttgtaacactgactctgggaggtggactgaggttccttatgggtccttctagcatcccctctccccttcagagatgagtgttgaaatttggggttctctgggtgtggcaggaggctggggggtgctccgctcatggccacttcatggcgggcttgggcacagttcggaaggcagccagctgtgtgtcccctgtctccggcctccttgtgtatgagtcaccattgggaagtcgccggcatttgttttaatttaacaggacttggctcatccccggagctctgccactggctcgtccttccttccactgtggagaggaagggggtggggtgcagagtgcttgcaagaaagcactttcccctcatcatctcaaaaaaaatttcttagcagaagcaatgagagaaatttactggcctgtcacaaagagtcactgctcatcagacgagagaaaggaaaagcagaggtcatcaattcatgggcagtgtctcaggaagggattaaatcatttagagacacgtccttaagaaatcattgaaggctcatgctgctgttttctttcctggccttcccatcgcatgcagatggcccctgtccagctgttcagatgctgcaccagcaccattctttttggaaatttgggcagacctcgtgtgtgtatgtgtatgtgcgtgtgtgtgtaatacacgctcatgtgcctacaaattgttatctgtgtgatatggttacataaacacacacaactgttgtctagccatgatggtttcagttttcttgtatttgtgttatgttgcgagctgctaccaattcattcagataaataagggcagaaataaatataacccgccagctacaggatgctggaaagctggttagagtccttggggggtggggtatggggggtgggggtggtctctgtcaccgcagtgccatgcagcgcctggcacggtggcgtcctcgctcctgtcatgagacagtgggaagccataaggcgcctggggctggcgcatcccttgggtcactgcacagtggtggggagctttagctgggatgccagctgggcctgggttcaggtcccagctccccactagtgacctgtgtggccagctgtcctcaaccttcagggctgtgtgagcctgaaacatgtggtgctgcatctggcatttagattgatgtgtgagggtccttttggtcattcgtgtgcctgctgctcaggtgcctgactcagcaggacagcccataggtcccagcatgacagcaggcatggggcatgaggtgggcataactaagatgttatgctggttaatttatgtgtcaacctgatggggccctggggtgcccaggtcagatatgattccgggtgtctgtgaggacatttctggatgagattagtgtcggaatcagctgcctgagtaatgcagacccttcccatgcggttggggagcatccactctgctcacggcctggagagaacagaaaggccaaggaaggaggacacctgccctttgagctggggcatgggtcctctcctgtccctggactggggttcacaccatgggctcccctggttctcaggccctcggactcagactgaagccaaacaatggctccccaggctccagcatgcagacagcgggtcctgggacttcttggcctccacagttctgtgagacagttcccatgacaaatctgtgccatggacctgggtgtctcctacaggttctgttcctctggaagaccccaacacacacatgaaggtggtggacacagcccagccagttgtgaaaaacaaacaagacagacagataagaggtctctgttggaattaaatagaagactttccaagcactaatctcctccttttgctcatcctagaaactgtggctgagcacccccctgcaccagccctgtgtccaaggatcactgatggatcccctgccctgcccagctcagtccaggggcggtgcttgcgttcttgggggatgaatagagatgctcagaggccaactgcagggccatgcctgggggctggatggtgctcccctgtctagggcactcagctgcatagggtgctcctctgcatagggtgctcccctgcatacagtgctcgcctgcatggggtgctcagctgcataggatgcttggctgcatacggctctcaactgcatagggtgctcccctgcatagggtgccccccagcatgggcacctgggtgggtccagagccatgtggctgccaccctctccctgtggaagggacccagtgaggagagctcagcaagaccacataacagaagggggttggagaggtgccagcctctgccaggaagcctcagtgcacagagcagccatggctgggctgatagactcatcttcagtcttattgccttcttacgggagacacagaggcagagatcatgcagggcagggtgaggagggcccaagcttttctcagggcctagggcccggagcatggccctcctgcccacccaccccggagtgccttcctgtctcttcacatgatattagcttccctcaccatcttctggtcccccagcagtgtcacctgaggcctgcctggagctatgtcaggagtatcaaccgcactgagagcttggtgagcaattcatagccttgcccagtgggagtctgagcatcccctgtggccacctgagtggatgtcaagtggggctgccctgcccccagcccatgcttgaccccgggatcctgagcagattcctggggcaggttctgccttccttccctggggctgtgtctctgtcactgctcaggagtgacagtgcctggacatgctccttgggcttctggggtgttggtgggtggtccaatggcagggacagaggagcagtgtccttgggatggccagaggcatcctcctatggataaagtcggtggccgatggctggagggctgactgcgggcctgctggggccctgctcactcactgcagtggaacaggagcccccgatgcagccccatcctcagcccagccaggggtgggagggagaggacagggcccttcgatgcacacccttttcccgtcccggagagaggggaggccgctgcatcatggcgcaccctcctggggcttgggtgaatgagtgcttactgctctttggagaggcaggtgacccatctgctttctgcattggttacgcagccccacacaatgcctggggactcagggcaggtcctgaaggtattgggcttctcttctgtccttctcactcccccagagagactgggggttgagtgtagccatagccagcccccctttcatgataatcagatgggctctgagtggagaccactggggctgcaggcacttatgagatgaggatgcagagataaagcccatggtcccttctctgcaggggccagagcccacagttgtgcagagaagggataaagccaggggagcacacgagcccccggcccacctgggagggcccagcaggctccccgagtgagccctggggtaggatgggcagcctggaggggaagaggctgaaggggccacagaccagcctgggcatagagcaggctgcaggtgaccagctcgtccctctgcccggaacctacctgggaaagtgcccatcccagcccaaatgggacggctactcccctggtgggaggcagggtgtgggactaaggggagatgctcagatggcgacaagccacctggagcttagacttggacctatggggtgtggaccaaggaaaggttgggggctccaggcctgggctatgcctggaaggacgatgggcaggggagatggggtccatcaggggcttctttgatgcaggcacagagtcggagccgggcttccggggagtacacaccctgaaaggtgtggagggggcaggatcagggactcggcgctggatggtgttggggtgaggcaaggcttggcccaggtcccggctctgcatctgggtaggtggctgtaggtgggcaactgctcctcatgggaagctgaccatctctgtgccgggctggcggacaggaggtgtccagaacagggcagggctgaagtgcagggggcccaggctggagactccccgattggagggcccccagtgaggggtcatcgaaagcaaagagtgcccctcagtgctcagggctaaaagggccaggtccaggactgctggaggagggcccaagaagtgggtcagggctcagacgccaagaagggaggggggcacagggcagggcaccatcagggccaggaagggacaaggggggccagggtccttcagatttgccagtcagcgttccatgaggagacaagcgtgagccagcaagacggtgggcatggccggtggttctccaaggcttcctcagggcacgcggtgggctgtgtggggtgtcacgtgagaaacggcactgagattagtaggcgtgacaaagctgaattcctcacaaccgctcccctcagggcccaccacgggctcctgcaagggcggggaatgcaggtgctgggccccgcgggaggagcagccacagcgggggacagggaggccagagccgagtggagaggagtgcgggactgaggaggcttttatcccccgaccttttctgaagagagaagagatagaagcagagtcatgagtgctagagacgggcagggaaggaaatggattaaaggagctggaggagagggtcccggagtgtacggaggagtgagaccctggccccaccgcctccctgggtgtgcgagtgggagtgtccaggcatgcatgtgcgtgtgggtgtgcgagggtgagtgtgcgagtctgggtacacgcgtgtgtggtagggagtacaggtgggggctggcgcagtgagaggtgggggctggacgaggcaagggtgagggccccttggtcagggccgcccactgcccgcagaagcccagggcagtgaaggcgcccaggagcaggtggttgggttgactcaggttggagaccccgctgggggtcagcagaagaatgaggggtggtgaggggcgctccaggcagggtggtgaggtagagagaagagaggcctttgcattttgcgtattctgttggtggaggaaatggtgagccatcaagggctgctggcagcctccccctaaaccagcccaggaaatgctggaagagagagactcagagcaaatatagacccacagggatgcctggagcacagacagggtcaggttcaggttgctggggaggccatggcacaggtggaggacagctggaagcctccacgtggtgctggccccctcctgctccctgggctgagccagcccaaggggcacgcaacctctgagctggcagtggccgctctgcccctggctacagcaggtatcagagcaggcagttcagacccaacacaaaacccaaacatgcctgcaggagcagctcccagttgcgcccagctcctaaagaacacacctgtgccatagaagacagacagagcaggacttagaacaagtgaccaaagtcctcagaggacttcgtcgtaagggagcatgcaatgaacatgagctcaaaagaagcggctgtcatgacaaaccagttggggatgttgggtgtaaaaaacataatttatagatagaatagaattcattaatataatgtatgaaactgtaatataattctaaataaatataattgttgaaaggggctagaagattttaccaagggactccccagaaagcatcaggagggtataaggaggtgggaggcaggttgagaggtgaggaaggtggaacaagacggcccctgcccgtctccaaggagtcctgggaagaaaggaagaataccgggtaggagaatatatttgaagaagggttggcagagaatttccaagaactaaatacagacacaagactttagatggaagtgttcacagagtggcaagcacacacaccagaaaaattagaatcacagagggaaaaacagttacagagatacaagagtgagtctgacctcagagttctcaaggcccgacagaaggcaggagaccaagtcaccaggtcagtggggagcatggacaggaggtgtgaagtgggcatagctaaataacgagaaggatcgaattggaatttcagcccaatataccattagtgtacaccactaacacccacataaatgatgctttgtatttttcttatctacaaatacatggaaatacagctgacccttaaacaatgtgggggctaggggcactgaaccccctcacagttgaaaatttgcatataacttttgacctcctcaaaacgtaactattaatagtctactgttcactgaaaccttactaataacacatacagtcaatgaacacatgttttgtaggttatatgtattatattctgtattcttttttattttattttttgttgtttacccacactacacagatgtatcacatgctatattcttcaatgaagtaggctagagaaaagaaagtggtattgagaaaataataagccagagaaatttatttactcattaagtggaagtggagcattgtaaaggtcttcatcctcatcttaagcaggctgaggaggaggaggaggaagggaaggggttggtcttgctttctcaggggtgtcagaggcagaagaaaatctgtgtgtaactggatgtgtgtggttcaaacccatgttgttcaagggtcagctgtaagtaagtaagtggcatgtggcctggagaggtaccacatatatggggaggctgctgatgttaagtgtgtgaggaaggagatagggacacgggagaaggggttagaccaacacaacagtatcaggggctgaagtggggccctcacagacagatgaaaaggagggggaagggaggcaccctgccaactggggaccacatagctttgtgcatctgaaagccactgaaaacagggaaattttatcacctctagacctgtagggagggaaaggaaataaggaaacacagtccactggggaccaagaaaaaagtggtggaaagaaaataagatggtaaaagtcattcaaaatatccttaagacagtaaaatgtaatgatgttacaggaccaccaggttcctacacctgctgcgcagttacagaccaatgcaccaagacagcaggctttgcagcagagaaagagtttcctgatctcagggcagctgagtgaggaggcaggagggaccctcacttcatctctctgaggagttttgggctggagtttttaaaggatcgtggaggtcaaggggtggaaaattggggccactgattggtggggctaaagaggatgcaatcatcggggtgtggacactgtatgttctggtgagtcagctgcttgtggggtccctcagaccagatggaatcagctgtttgattggtatgcaggacctagaaggatatctcaagtggacaacttaacacttcacaatgttcaagttgctatctatagaggatagttgttatctatctgaacttaggggaactggggccttgtaacggattacaaggtgattctgaggcagtatgcatggaatggtagtgaggaagggtcagagagcaagctggcctagaagccaacactcaggacactgcaagcttggtttattttcctttctctccctcccttctttcctaattaattttataaaacgtatagggatggattcaataagattaaactcatctattcgaaacatggattctcaggctgtgtttttttacatttttgttttgttttgttttgtttttaaagcaagctatctgctatgaagtgttaacagaaaggaagtgggtgtgggaagcgaccagtaaggcagggagaggtgcatggggtggggtggagggcagtaccaggtaacttggaaggaggtcatgcacctggaagatgcagccaccagcctcagtgagacaacagcaaacctagcatgtccccaggcatggtgggaactttgaacatacctcactctaaaatttgcatcaaacagaataaaaatcatgaaaataaatagatctgaaatacagattttaagtttgggctgctgggcagatacagaatcctgtaccccatgcgccgggcattaacattttttccagcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcaggtaaaatggcactagagggaaatttataaccttaagtgctgtgttagagaacaagatagaaggcaaattaatgagctctgcgttcaacagcagatgttaggaaaagaggcacagaacaggctcagggaagaggccgaaggcagagccgggctggagaaggagagctcagggaggctaagagcagtggcctggggaaggggcctggggccgtgggtcaaggatggagtcctgttgggagtgtggggagtgggtcagggatgctggattcagcatttgaggatgggctgtgctgtgtggatgaaccatcaagatagacatcaggccccccagaatttggcaagactggaggtagagccaagtgaatccacgccagagtcctggattactatgggccatggcagtggtgtggagagaccactcagacctaatgagcctgcaagactgtgggttccgtctgcttacaggggagagctgggatttaagggaacaaaagccttggggaaagggagcgggctgctcaggggaagtggatatcagtgaaagccaggttttgtttaaggtgagatgtccgtgcaagttgagtggaggggtcatggggcacctgtttctctgagtccccagggggcagggagagggatgggttagggctgggtggggaccagggtggctggtggtggtggttatacccaagcacagcagggttgagactgacaagctcatccagcttctgaatcctgatggaggccccagagcctggtgccctggggactctgcggagggtggtgcaggagcacggccctcaggtgctgggagtgaggtgagcagggtcaccccacacctggcctgcccctcctcccttgaaaccagcggtgtgtctgagcactgggcctgaaagcatggcatctggaggcccaaggctaatgcccatggcctcctctgcctgctctgcttgtccaggggctgagctgtcctggtctctccctctgctccttcatgcagaggtcttcagagcaccctaatgtgtccaatcaaggccaggcttgttggtgagacactctcggtccccagctccatgctagatgtctccaccctcaaaggacccagcatctcatgacttcatgtcccactagcagtccctgtgcccagttcacccatccccactgaccaccaatgtttgatttttccttcagaagcatgtgaggaaatggattgttgattagcctgattcaatcattctacattgtaaacatatcaaagcatcaccttgtatcccataaatgtatacaattattatttgtcaataaaaaataaaattaaaaaagattcagttcccagctgcctcctccaggaagcgtgcagcactctcccttgctgaggaccaactttacaccagttcttaccctggaccctgcagagggcagagggcacttgggctgcccatcagggacacatccatgcctctctagctttctaggaagcttcctgtctcagcccaggactttgggaaggtggaggtagtcacctcctacagtcaggacagctgcagttcagagggaagaggcacaaagtcctcaggttgaagttacccagctggaatttcctttctcccactgaaagaggatggtgatatttgggactcagggttgatgtcaccatgggaggtctactgggacagatgctgggatgttgagctcatgcctgcagctgtacacagtgggcagtgtggctgtggctctgggcacctctttccttggtgccagatgtgctgcctggccctgtatgtaggaggctggacctgctgggccttgtggcagggcctcagggtccttctggtcacctcttcctccctgcaggtgcctctgcttttgagaaactcaaagccaaggacaggtcactggatgtgctgggggcaccaggactggtggggtagggggtccttggtgccaagttcaccccaacctcagcagggagaaggggctttggaaaggccctggcccagggagggggcggccaagcaggcctggctggggaggcccaggcattgcagttgggccaggggcccgtgtgagggaggcagcctccccttctctaggatggggccagtgcccagctctgcgagacccgtgtcctgcaccccacaccccagtggagcacagcatgaggccctcaggcccgatcccgtggttgctggttctgcgaggagattttgaatccccactagattgtcttaaggttcataggcatttttgggttttctatgtctttttcagacacgttccaagtttggtctcttcaggttactgtctgttttgtcagttattggcagaataatgttgtatagtaatttgtaaaatgtctgttatatttaaagttatgtctccatttgatttattgtgttatatgctgtgccatccctcttttcattttcttggtcaattattctagaggttggtttacttttattagtattttcaaagaatcaccattttaattttgttgaccctttctttttttaatttttaattttcgtgggtacattttagtaggtgtatatatttatggggtatgtgagatattttgatacaggcatgcagtacacaataatcacatcggctgggtgtggtggttcacgcttgtaatcccagcactttgggaggtcgaggcaggtggatcacaaagtcaggagtttgagaccagcttggtcaacatggtgaaacaccgtctctactaaaaatacaaaaaattagctgggcatggtggtgggcacctgtaatcccagctacttgggaggctgaggcaggagaatcacttgaacccaggaggcagaggttgcagtgagccgagattgtgccactgcactccaacctgggcaacagtgcgagactccatctaaaaaataaaaataaaatcacatcagggtgaatgggttattcatcccctcaagcatttatcctttgtgttataaacaatccaattatactcttagttatttttaaatatacaattgaattactattgactacagtcaccctgttgtactaaatagtaggtcttattcattctttctaactactttgtttgtacctatttatcttcatcatttctcttactcccctactacccttcccagactctggtgaccatccttctactctcttcctcaataagttcaagtgttttaattttcagcttccacaaataagtgagaacatgtgaagtttgtctttctgtgcctggcttacttcacttaacataatgacctccagttccatccatgttgttgcaaatgacaggatctcattcttttttatggctgaacagtactccattgtgtacatgtactacatttgctttatccattcatctgttgacggacacttaggttgcttccaaatcttggctattgtgaacagtgctgaaaacacaggaatgcggctatctcttttgatatactaattttctttcttttgggtatatacctagcagtgggattcctggattgtatggtaactctatttttagttttttgaggaacctccaaactgttctctatagtgattgtactaatttatattcccatcaaaagtagacaagggttctgttttcttcacattcttgccagcatttgttattgcctgtcttttggataaaagccattttaactggggtgagatgatatctcgttgtagctttgatttgaatttctctgagatcaatgatgttgactccttttcatatgctgttttgccatttgtatgtcttcttttgagaaatgcctattcaaatctatgctgagacacctggagctggaggtgggatgacacaagcacccctgtggctgccaccactaggattgtgctgggccaaacctgaaaccagcacagcactgggtctcacccagggcccattgtaaccactacctggctattacctatgtttgcttaaggccctagagctctgcaatcagtaggggtgaagccagccaggcttgtgtccttcccttcaggatggcaagttcccccaagccctggacaggtctagatacactgtctgggagccagtgactggagtcaagaaccttagaaatctgcttgatgctttattctactgcaggtaagccagcactcaaatcacaagacaaagtcctcacttttctctctgctttccacagaaagaggagcctctcccatggtcatggccaccacaggcctacatgggatactgccaggctaccaccaatgttcactttaagcccaagcgcccttcagtcagcttatggtcaatgctgccaggcctggtagtcacccttcagggcagtgggctcccctctggcccaaggcaggtccagaaatgtcatccaagagccaaggcctttggaatcagggatcccaggagcctgcttggtgctctgctccactgaactgagctggtacataaggtgcaagactaagtcccctttactttcccctctgcttttctcaagcagaagcagtctcttaccataaccaccatagctgggaatgtgctggttctcccctgaagccagcatgtctcagagtctcacccaaggcacatggcatactacctggatatcactactggttcttcaggacccaagggctctttagtcagcaggtgatgaatcctgccaggactcggtccttcccttcaaggcagtgggttcctttctggcccaaggtgtgtctagaaatgtcatccaagagctagggctcaaaatgagggccttatgaccctgaacagtgccctattctgtggctgagctggtatccaagacacaagacaaagttctctttagttccctctcccctccttaagtggaggaaagaagtcgctttcgttgctgtgagctgtgctgcctagggctgagggaaaaatagcacaagcatgccctcagccagcccagctggtgcctcactaggtcacatgcctcccacatccactggctctgagcccagcacggcactaggacttgcctgggaattgcagtccttgtggcctagattgactttcaagtctatttaggaccccagagcctttgagcccacagtggtggggcttgcaaaaacttatgttccaaccattgggatggatgatgatgcccctctgtctagggctggtctaaatgcttcctctgtgggtgggtgtcaagcaagtttagcctggtttttctttctgctctgacagagcagcacagagttcaatgcagggtcccataatcactgcactctccttcctccagtgcacagattttccatgccacaggaccactactggggagtggaggaggggtggcttcagggattcaagactgtgttttctaccttcctcggtgcctctttcagcgataggaagttaaaaccaggtactgtggttgctcacctgattgttggctcttatgaaggcttttttttgtgtatgtagatagtagttaaatttggtgttcctgcagtgggggcgataggtgaaatttctattcagccatcttgctctgctctcccttgaccctttctgttttatctttatttttccatttcattaatttttgctcaaatcttgtgcatttctatctgcaagcttatttctaaacttttattaatgtcttcatctgggctccgaatagcctttcttaataggtaaagattataaattcctgtagggtgttctagtggcagccctcaatttttgatatgtattattttatcagtgttgagttacaagcagttgcatagtatgaagtcttatgtgtctcactttttgcactcaatattttgtttgtgagatgttacatgtagccataatttatttattctcagatattatacataatctttcataaatgaatatgtcaccatttttccatctctctgtttgtggatatctggcttgtttccaatctttggatattatgaataatgctgctgtgaccatccttgtacacaactcttgaggtacatgtccatacattcatgttgattatgtatctaggaatgaaatctctggggcataggatatgcttatgttaaattctattccatgatgccaactgttttccaaattatttgtacaacatgcactttctccagcagtgtgtgagtacctacttctcctccagtcttgccaatgcttactattgtcagtttttaaagttttagccatttggcagatgtataatggcggctcaaagaggtgtgaatttacattttcctgactactaatgtggttaaacaattttgtatgtgtgtatgaattccctgctgctatggtttgaatgtcccctctaaaactcatgtggaaacttaatccccaatgtggcagtattgagaggtgggggcctttaagaggtgattgcatcatgagggctctgctcctaattcattcatggattaatgggttagtgaattaatacattatcatgagaggcaaacaggtggctttataagaagaggaagagagatctgagctagcacactagcatgctcagcccccttgccatgtgacaccttgagccaccttgggactctgcacagagtccccaccagcaggaaagctctcatcagatgtgaccccttgactttggacttctcagactccataactgtaataattaaattccttttctttatacattgcccttctttgggtaagtcctagttcaggtcctccatattcttaattattttctgtctactagttctaacagttgctgagagggagatgttgaagtctccaactataattatgaatttgtctctcctttcagctctgtcaatgtttgtttcatgtattttgaggcactgcttttggtgcatatgcctttagaattgttatgacttcctggtggatttaattatgggtatgttagagcttaagactaccattttgttatttgttttctgtttgtttcctctggttatcattcctttttctcttttattgttacttgaatacttcttagtatttcattttgacttatttatagtgtttttgagtgtatttcttcatagagtttttattttggttatttcaatagacatatgtgacttatcgcagtctgctggtatcaatgttttgccaccttgaaggacatgtggaaacctttcttccatttaggtcccttatctttctttctttcttccttttttttttttttttttttgagacagagtctcactctgtcgcccaggctgcagtgcaatgaagcgaacttccgcatcctaggttcaaacaattctcctgcctcagcctcccgagtagctggaattacaggcattcgctactacccccagctaactttttgtatttttagtagagatggtatttcactatgttggccaggctggtcttgaactcctgacctcaggtgatccacctgcctcgccctcccagagtgctgggattacaggcatgagccaccgtgcctggcccctttcacaatgttatcttgagcatcaaataatgctataatttttgttttgatcttcagattcttaaaataaaactcacatgagaaacaatggtctatggtttgtactcatatgcttcgtttttatgttgttctttcttatgctccatggctccttcttttattatttccttcctgctgaaggtcttcctttagtcaatttttaaggataggtctgaaattaacaaattcttctagctttccttcatctgagaatgtctttagtgccccttcattttggtaaaatagtcttgccagatagagattgtggttgacagttcttttctttcagcacctgaaaaatgttgtaccagttccttctggccttaaatataaaaaagatttattatgacaatatatcttttataagaggttatatcacccatggtttcaaataagaaatccactgtcaaaccaaacaccgcatattctcactcacaggtgggaattgaacaatgagaacacatggacacaggaaggggaacatcacactctggggactgttgtggggtggggggaggagggagggatagcattgggagatatacctaattctagatgatgagttagtgggtgcagcacaccagcatggcacatgtatacatatgtaactaacctgcacattgtgcacatgtaccctaaaacttaaagtataataataataataataaaaagaaagagtaaaaaaaaagaaaaagaaaaaaaagaaatccactgtcattcaaatggcacttgtaggtaaaatgacatttttttttctggttgttttcaatattattgtctttagttttaataagctcaattatgatgtgtcttcattattacatatgtatagatgacctgttggccctgtttctctggagaaccctgactcttacatggtctatgagcctagaatattttgttgtgccagaaagtataggagtcctagaaaactgattagggcaaaacaaaggacccaggatccagcttgatgaggctcccactggccagatctgagataatctgagcataaaaatgaataatgacaggattgtaacccggtgactaagaacaggatacatgctatcattttaagttataaaatgaatgaatgaacattcttttttacaaggaatggtgtggaattagaaaaccaccattttgtagccaccattggaataattgattcaggcagaaaacatcaatggatgttcaaatcattagatggaagttaaatgagaaatagatttatttatatgaattactttttaattttaaaggggaaaaaaagataccattacaatgggaaaatctggcagatactaccatgatattgaatgaaggttagtaacatgagtaacaagacaaaccagcatcatgttgatgtcctgagaagaatacagcaccattcctgccagaaatgcatggcccaaatctaatcacaaaggaacatcaaactcaagtaaaacacattgtacggaacagtggcctgcactcttcaacgatgtcaaaaatcaatgttaaattagataattatattatggttatataagagaatgtccttgttttgagacacaggctgaaatgtttggaaatggttgtgatatctgcaaggtattcttaaatgttacaaagagagagagagcgcgcgcacaatagagcataggcaggacaaaaatgttacctgatgactccaggcaaagtgtttttggaggtggactgtgttactcctaaaaccaagtgtgttctgccagctcagggattctgggctgcttggatttttgaaacaaacacacactcatcagagggctgtaaacagtgcaggtgatgcctgaacacagctgactgctatcttggtttaaaaatgcagactctggagctggatggttgaatctctattacacccccaatttgtgtgatcttggtcaagttcattgacttctttaggcttcagttccctcatctgtaaaacagtatgagaatagtcgctgtgttctaagattgctttgaagattaacatgagtcggtaatatctataatgcttataagggtgcctggcacacagtaacgatgaataaatgctaattattgtatttactattagtagtaattggacaggcagcaaagaagatccttcaactttctgtctcttaatggtctgaaacttccatctgttactatttaaaagaatttgggtaagtcctcgtacagaaaatgagtctttcttaatttcggaatgatggtaaaacattgggttttagtcccaccagtattttctacctggaaaggaactgagccagctgggtgggcagtacagaaatggaaggagggagtagggaactgatcctgcttgcaaagacaaaagaacaaggagaccctggggaatgcagaacctggcaccatttttcttcaactaccatgaaaatagacagactgcctgatacggtttggctgtatccccacccaaatctcaacttggattgtgtctcccagaattcccacttgttgtaggggggaccgaggggaaggtaattgaatcatgggggctggtctttcccatgatagtgaataagtctcatgagatctgatgggtttatcaggggtttccacttttgcttcttcctcattttctcttgccaccaccacgtaagaagtacctttcacctcccaccatgattctgaggactccccagccatgtggaagtgcaagtccaattaaacctctttttcttcccagtcccaggtatgtctttatcagcagtgtgaaaacagaccaatacactgcctgacactctttgatgaatagtttttgcgtcaaagagtaaattgggagtaaaataacagaagataaaaacaaaatattttggaaccaaaagaagaatgcctaagctatgctcagtagtacattcatagttttaaatggccttaaaatttaaaagagagagtttcatgaaccattatgcttatatcttggttcttccaaagtgctgctaaagtcttagcctgctgcaatgagtacctgggcaggtatgtgaaatactccaccttggtagagataacagaaacataaccttgaccttcccattaaaactaaagggaaaattcgactgaagttttcaagtagtacccttaaggaatcacacatagaaggtactcaataaatattatagcttgaataaataaaacaatgccactgagagcctcaagggtctggagtactctcagataactggcgtattagttagatgttgctctgtaacaaaccacttcaaaacttagaagttacccagctggaaatttcctttctcccactgaagatgggagcctattttaggggcctaaaatagtaaccttttattatttctcatgagtccacaggacgatggggcacttctgctactctgggctggatgtggctgatcttaactggctcatcagtgatcagccagtggattggctgggcctggctcatctcagatgacttcagccctccttcccatgtcctgcacatcccttcagcaggctaagctgggcttgttcttatggcagtgccagaggtccaagaaatgagtgaaaatgcacatgtgcttttccaagcctctgatcccatcctgctggccaaagcatgtcacagcatcaagcccaacatcattttgggagggccctacttaaacgaatggcgagagtgatatatgaaaaattgggccaatttctgcatgaatcctctatgattgggaatcacgtagataagtgttttgggacagttcatccaaatgacagacataaaataatgaaatgtgaaatgacagacataaaataatgaaatgcgtggccatctccttaccacagttgattctaacccagttgttgaattatttgccatacctcactcagttcagcatggctatcagtatgatgcacccttctatgtctctgaggatttataagagatctaaattttttaaaaagaaagaaactggactgccatccaacagttcacaaaaatcaatttcagatatatcaaagacccagaggtaaaaagcaaaatttcaaagctttcaaaattaaatgggggtgggggaatctcttaatatccttagagtagaaaaaattctttaaaaagacacaaaatgcactatctatataggacgcattttcaaatctagccatattgaaattgatgatttttgttaatcaaaagttacctcaaagggaatgtttttaaaagtcatgatatgagataaaatatttgtagcacatgtaaccaacaagtgactagaacctgggtacataaagaactcctgtaaacagtgttgtgctggaagatgtttaacaactgactctcaggccctaaaagtccttatttttagcatttgcttgtttccaggatataaacacttccatgtggccaatttcaagccactaaggtaaggtcaccaagcagggccttggggatagatggtcgcagttggctctcacaaggcaggtataaaggctgcagcacaaaagtcaacatgaaaaacaaaacaacccaatgggggccaggcacagtggctcaagcctataatcccagcactttgggaggccgaggcgggtggatcacctgaggtccggagcttgagactagcctgaccaacatggagaaacctcatctctactaaaaatacaaaattagccagcgtgatggtgcatgcctgtagtcccagctacttgggaggctgaggaaggagaatcgcttgagcctgggaggcagaggttgtggtgagccgagatcacgccattgcactccagcctgggtgacaagagcaaaactctgagggaaaaaaaaaccaataggaaaagtgcaaaagacttcagaaggcttttatgagggctgtcttagttcatttgtgttgctgtgaagagatacttgagtgtgggtggtttataaggaaaagagttgtatttggctcaacgttctgtaggctgtgcaagaagcatggagctggcattaggcaagggcctcacgctgcttccactcatggcagaagggcaagggagcccatgtgtggagatcactcggcaagagagaaaggcaaggaggtgccaggctctctctaacaagcaggaacgaatagagtgagaactcacactccttccccatggagggcattaaagtattcatgagggatccgcccccatgacccaaacacctcccattaggccccacctccaacactgggaatcaaatttcaacatgagatttggaggagaaaaacagacaatatcaaactatagcaggggcataaaagaaaacctaaatggacaataaaaacctgaaaagatgctcaatcttgtaactgatgagggaaatgcaaattaaagccacaatcagatacatttcacaccctccagattgacagaagttaaaaagtttgtcagtttggggttggtgattcggagctgtggaagctctcacccacggctggcggagcctgtgctagtacaaaccactgtgagaagcagtttggcatttcctagaagaggtgactgtgcacaccctacaaccagcactttcattcctgtaaatgtaaacgtgccctagggaaactcttgcccatgcaccccgcaggacacacagggttcgcgggaggaccattagcaatgggaaaaaatgaaaacaacccatgtgcccatcagcaacaaaataaactataatctctgtatatgatggaatacaatttcacagcagtaaaactaatgaattgtggctacaggtatcaatatggacaaatcccaagaacttcatggagagagagagaatcacaaaagaataaacgtcacataactgcaatactataaagttccttatctatactaacaaagacaggggtgtttatcagcaaactcaatttggtggttggagagaggggcaggagagcaagaggggtatgatctgagcgtggggcaggaagaggggctaatccatgcgactggaaatagttcgttctcaaactgggtgtgagtgtggaggtgctcactgcattgttgctgctgagacatacgcttgcattggatagattcttccacgtgtgtatttcaaatttggcttcatcacaaggcttgtgggggagtgacaaagcagtgtattaagtgtgacagctgaggaaagccccagcagcaggggacagagagaggggcacatgttgtcacctggaggtggggtggttgcgggagaaacgtccaggctacaaaccgagttgcgaatcacagagggacttaggccgggaaggggcagcacggcgccctccaggcagagaagcagccccgcggccaccctgatgcggcgcggactcctcctgtccagttctctgtcacacctgctgcctgccccctcgccaacccctgcatacatggcccgcatatcagaggcggacgaagaagcggccagaacttagccagtcttccttcttcatcttccttcctcctagtaaaacacacacacacacacacacacacacacacacacacacacaaatgggcattagcctttcctctggtcgtgcctctatttcagcttgagattttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgcggctgggccttaggtcttgcccccagtttcctatgccctaggacgtccccttgggggccagccacccccagcccgcggagggaagaggggcccttccttcgcggaccgagggcggcagcctgtgtggggatacctgcgcaggtgcagccccggtgagagctccttaccaagaaagagggacattcatttccctctccaaggtagcagcgttgaaaggcttctccacagcattactcagtccaactaatgatgggaaaaggagggaaaaacgagggcgccgagccgcaaccgcttgcctacctccacctaaaacgcaaacacagcccgagtcgccagtgaccctgactcaggcggccgcgggcgttccccacggcaggacctggagccacacccgggccctcggggctccatggcagcgcggcagcgcctccttcgcggagaagccccactgccaggagaaccactgccgtcgggagacgacgtctgtatttgtagggagtgaaaggaggcgccgagtcccccacgtttcatcgcagggtcttcggggcagaattcggagacacctgtcacgatgggagcagtcagggctttcctggttttggggcctctggcttaggtgggctggcaatgcctctcctttcattcctgataaacatgctgggccggagcacagcggccatggggctgtttcttgtgagccacggctagttctaaactgtactgatttggacacctgccaccagatgagaaattagtaaaatgtggttaccaagggactgcttctctgctctagctgtgaacggggtccttagcggcctgcatgcccgcgcctctccagactgagaccaaagacttccgcgccaccgtcggcagctcgcgaacttagacttcagaccgtctgccgcactgcaataaagagaccatggtggggataccttttaaatgatttaaatgtgtccttccttctgcagcacacacacgtcctcctgaactggacacctggccaggccaacgaaaaaggagaagctcttttgtaaggtggcagggacgcacccccttagctagagacaggcttctaggtggctcgccttctactggtagaacatgtagggttatctgctaaagtgtgggacctgctacattgaagccaatcttctctgagcaggactcaatttatttttttcttaattgcaacacatgaaaattttaggtcaccaagaaacactagtcaaagggtttcattttctgtttatggcctatttattacaattcagaagaaaaatgaccaactagaaaaaaaatatgtaacacgtatcacggactgtcaaatgtctttttttttttagacaaggtctcactctgtgaccaggctagggtgcagcggtgtgatcttggctcactgcagccttgaactcccaggcttaagcaattctcccacctcagccttctgagtagctgggactatggcatgcaccaccacacctgggtaatttttgtatttttttgtagagaccagggtttcgccacgggcccaggctggatttttttctttatatgtaagaaaacttggtggagacggggtttcgctgtgttggccgggctggtctccagctcctaactgcgagtgatctgccagcctcggcctcccaaggtgcggggattgcagatggagtctcgttcactcagtgctcaatgttgcccaagctggagtgcagtggcatgatctcggctagctacaacctccacctcccagccacctgccttggcctcccaaagtgccgagattgcagcctctgccctgccgccaccccgtctgggaagtgaggagcatctctgcctggccgcccatcgtctgggatgtgaggagcccctctgcccggctgcccagtctgggaagtgaggagcgcctcttcccgggcgccatcccaactaggaagtgaggagcgtctctgcctggccgcccatcgtctgagatgtagggagcgcctctgccccatctgggatgtgaggagtgcctctgcccggctgcgaccccgtctgggaggtgaggagtgtctctgcccagcagccccgtctgagaagcgaggagcccctccgcccagcagccgccccatctgagaagtgaggagcccctccgcccggcagctgccccatctgagaagtgaggagcgtctccgcctggcagccgccccgtccgggagggaggtggggggcagacccctcccggccagcctccccgtccgggagggagttgggggccagcccctgcccggccagctgccctgtccgggagggaggtggggggcgcctctgcccggctgccccttctgggaagtgaggagcccctctgcccggccgccaccctgtctgggaggtgtacccaacagctcattgagaacgggccatgatgatgatggtggttttgtggaatagaaaagggggaaatgtgggaaaagatagggaaatcagattgttgctgtgtctgtgtagaaagaagtagacataggagactccattttgttctgtactaagaaagattcttctgccttgggatgctgttgatctatgaccttgctcccaaccctgtgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctttgttcacttatctgctgaccttccctccactattgtcctatgaccctgccaaatccccttctgggagaaacacccaagaatgatcaattaaaaaaaaaaaaaagaaaacttggcaaaggatatggacagacaggaaatccagctggatcttcagcatataaaagatgctctaccacactggtaataagaaaactatactttaaaactacaagatactattttacagtctcagataggccaagttcaaaaatgaggagagtggctcgtgtctgggaggctgtggggtctgcgcggtcactcattactctccttatgccccctggggagatggcatggcaggcagtttaccttccaaaggtaacagttcacacactctttaacaaagcaattctgctcctttgtcctacggacttgcttgcatatgaaatggcctgccagtgagaatgtgcactgcaacgtggtttccagtagcgaatatgaaaccaatctacatctccataaataagagatgggtgagatagtgatgcattcacagaaccatgagtagccatgaaaaaaatgagtgtctttatatgaactaatatgcagagatctctaagaaatattattaaaggaaatgcaaggtgcagaactgtgggtacacctaccactaatgtaaaacactaaaaagcattgtgtaaggatataaaagaggttgctcatagtgttccttccagggaaagaaaatgggatgactgtgggagaagggttggaggagatttaactttcactttcaaactttttgctgtgttcatactttgtctattcaaaaaaattaacaaataaaaatgcatttaaaaattagaggccagtattacctacagtttccagccttctgtgtaaaagcagatgtattcacattctccagagaaacagaaccactaaggtatcaatatttccatatctctatatctgtctatatatacagatttattacaaggaattggaggttgagaaatccagaccccaggcagcaaatagtggtatgtgacttgccttcatcaacagaaaatgctggaagtgatgttttggggcttacaattccagtctttagagaattgttagcttctgcttctcctcttctagagtccagacaaggtaaggtgttaaactgtactgagacagccatgctgtgaggaagcccaagttatccatatggagagagagacaacataagggagcactgaggttctagacttgtgggtggagacttattggaccctctagcctagctcagctccatatatgtagtccatgccatgaggtggagcagaagagctgcccagccatgccctgcccaaactctcaacccacagaattgtgagaaacaataaattgttgtcttaaaccactaaattttggaatgttttgttgcatagcaataggtttgcccctaacatactggatgtcacaaggtgacaattcctttacagggacagctgagtgaccatcccatgggaaacaaatatttgcattcctttatcatgttactgaggcgacatctaattgtatccttctttttaccttacgtgagacactaatgggtggttttctccttgatcttttacagaagcaaacacagcatcaaacagcaaggggcttctaataggggatttgcagatggccagcctatctcagaataggacacaaagatcttggggtaccttgtttaggattcagacagtagtccctgtgaatcctatatacttgctatgaaaaggaaaaattggcttgtcaatttgaggtcaaaatggtggataggaggcaggactagcagctcctactcagacagagcagcacgtggagattcacatcatgaactacctcaagaacataccaggaaacctgagagaatccacagaccccttgaaggaggtggattgccactgcaggctccatgggacagctgaggaaactgccagtctgtttgctttctcacctggaaggcttgtagcctggggcaagttctcagccctgctcactggctgcctggaaataaactgagtgctgttgggggaccacagtgggagtgagatcagccttttgggctgtgggctgcatggcagctgggtgacgcctgtggctgccagctttcccccccttccctggcaacctgtgtgatgcagcagaagcagctataatccccttggtaacataactccattggcctgggaaccacacctccaccccctaaagcagcagtggcaggccccgcacaaggagagtctgagctcagacatgcctaaccctgaccagacctgatggtctttctctacctgccctggtaacagaagacaaaggacataatctcttgggaactctatggccctgcctaccacctgaccttagggcaagcttgtatcctccctatactactgcagctgatgtgctcttaaaagcaccacctcctggctggaggccaaccaaaacaaaactagcaccttttgttgttgtcattgttgttgagacagagtttccctcttgttgcccagactggagtgcaatggcatgatctcagctcactgcaacctctgcctctcaggttcaagctattctcctgcctcagcctcccaaagtagctgggattacaggtgcccaccaacgtgcccagctaatttttttgtatttttagttgagacggggtttcaccatgttggccaggctggtcttgaacgcctgacctcaggtgatccacccgcctcggcctcctgaagtcctgggattacaggtgtgagccaccacacccaaccaaaactagcacacttaataaaaatacaaccaaggaccctcacagagtccaggcgctggtatccacagctgagagacctaaagacggatcacatcacaggactctttgcagacactcctcagtaccagcccagaggctggtagctcttctgggtggctagatctagaagagaaataccaatcactgcaatttggctctcaggaagtcctattccaagggtgtgggggagagcaccacatcaagggagaaccctgtgggacaaaggaatctaaacagcagcccttgagtcccagatcttccctctgacatagcccacacaaatgagaaggaactagaaaaacaattctggtaatacaacaaaacaatgttctttaacaccctcaaaaaatcacgctaacttaccagcaatggatccaaaccaaaatgaaatccctgaactgccagaaaaagaattcagaaggtcaattgttaagctaatcaaggaggcaccagagaaaggtgaagtcctacttaaagaaattttaaaaaatgatataggatatgtgataaacatcataaaaaatgatataggatatatcatataagatataggatatatgacaggttttccttcatacgttacctgatacttttgcctcataactcttaagattctttccttcatcttgactagataatgtgatgaatatgtgccaaggtaatgatctttttgtgatgaatttccaaggttttctttgagcttcttgtatttggatgtctaggtctctagaaaggccagggaagttttccttgattattccctcaaatatgttttttaaacttttagatttcttttcttcctcaggaatatcaattattcttatattttgtcacttaacaaagcaagcactagtagctattcttacatcagacaaaacaaactttaaagcagcggcagttaaaaaagacaaagagagacattatataatgatgaacagactagcccaacaggaaaatatcacaatactaaatatatattcacctaacacaggagctcccagatttataaaacaattactactagacctaagaaatgagatagacagcaacacaataatagtgggggacttcaatactccacagacagcactagtcaggtcatcaagacataaggtcaacaaagaaacaatagacttaaactataccctagaacaaatggacttaacagatatttacagaagattctacccaacaactgcagaatatagattcaatgcatcagcacagggaacgtactccaagacagaccatatgataggccacaaaacaagtctcaacaaatttaagaaaatagagattatatcaaatactctctcagaccacagtggaataaaattggaaatcaactctaaaaggaaccctcaaaaccatgcaaatacacagaaattaacctgctcctgaatgatctttgggtcaacaatgaaatcaagatgaaaattaacaaattcattgaactcaacaataatagtgaaacaacctatcaaaacttctgggatacagcaaacgcagtgctaagaggaaaggtcagaagttcagagtgttaaatgcctacatcaaaaattccgaaaaggcacaaatagacaatctaaggtcacacctcgaggaactagagaaataagaacaaaccaaaccccaacccagcagaagaaaagaaataaccaagataagagcagtactaaatgaaattgaaacaacaacaacagaaaaaatacagaagataaatggaacaaaaagctggttcaaaagataaataaaattgatagaccattagtgagattaaccaacaaaagaagagagaagatctaaataagctcaatcagaaacgaaacaggagatattaccactgataccacagaaatataaaagatccttcaagggtactatgaacacctttacacgcataaactagaaaacctagatgagatgaatacattcctggaaatacacaaccctccttgattaaaccaggaagaaacagaaactctgaacagaccaataacaaggagtgagattgaaatggtatctaaaaagttaccaacaaaaaaaaaaggtctacgaccagacgaattcacaactgaatatatatcagacattccaagaagaattggtaccaatcctattgacactattccaaaagacagagaaagagggaatccttcctaaatcattccatgaatccagtatcaccctaataccaaaaccaggaaaggaaataacaaaaaaaagaaaactacagatcaatatccctgatgaacatagatgcgaaaatcctcaacaaaatactagctaacagaatccaacagcatatcaaaaagataatccaccatgatcaagtgggtttcatactagggatgtagggatggtttaatatatgcaagtcaataaatgtgatacaccacataaacagaattaaaaacaaaaaccacatgatcatctcaatacacacagaaaaaacatttgacaaaatccagcatctgattaaatgctcaaatgattaaaaccctcagcaaaattcgcatacaaaggacatacctcactgtaataaaataaaatattatcactgtaataaaagccatctatgacaaatccacagcaaacataatactgaatgggaaaaagttgataggattccctctgagaactggaacaaaacaaggatgcccactcttaccaatctattcaacatagtattggaagttctgcccagaatattcagacaagagagaagaataaagggcatccaaatcagtaaagaggatgtcaaactgtcactgtatgctgatgacatgatcatatacctagaaaaccataagggctcatccaaaacgctcctagaactggcaaatgaattcagcaaaattccaggatacaaaattaatgtacagaaatgaatagctctgctatacgccaacagcgaccaagctgaaaatcaaatcaagaactcaatcccttttacaataggtgcaaaaaataaaaataaaatacctagggctatacctaaccaaggagatgaaagacctctacgaggaaaactacaaaacactgctgaaagaaatcatagatgacacacaaatggaaacacatcccctactcatgaatgagtagaatcaatattgtgaaaatgaccatactgtcaaaagcaatctatagattcaatgcaattcccctcagaatatcatcatcattcttcacagaactaggaaaaaatcctaaaattcgaatgaaaccaaaaaagaccatagagagccaaagcaagactaaacaacaacaacaacaaaatctggaggaatcacattacccaacttcaaactatactgcaaaactatagttaccaaaacaatatggtactagtataaaaataggcacataaaccaatggaacagaatagagaacccagaaatacagccaaataattacagtcaactgatctttgacaaagcaaacaaaaacataaagtggggaaaggacaccctattcaacaaatgctgctgggataattggcaagccatatgaagctgaatgaaactggatcctcatctctcaccttacacaaaaatcaactcaagatggatcaaagacttaaatctaagaccagaaaccataaaaattctagaagataacattggaaaaacccttgtagacattggcttagatatagacttcatgaccaagaacccaaaagcaaatggaacaaaaccaaagataaatagatgaaactgaattaaactaaaaagcttctgcacagcagaagaaatagccagcaaaataaacagacaacacacagagtgggagaaaatattcacaatctatacttctgacaaaagactgataaccagaatctgcaaggaactcaaacaaatcagcaggaaaaaacaaacaaacaaacaaacaccccagaattgggcaaaggacatgaatagacaattctcaaaagaagatatacaaatggccaaaaaacatatgaaaaatgctcaatatcactattatcagggaagtgtgaataaaaaccacaatgcaataccgccttactcctgcaataatggccataatcaaaaaatagatgttggcgtgaatgtggtgaaaagggaacacttttacactgttggtgggaatgtaaactagtacaaccactatggaaaacagtgtggagattccttaaagaactgaaagtagatctaccgtttgatccagcaatcccattcctgggtatccatccagaggaaaataagtcattatatgaaaaagatacttgcacacgcatgtttttttttgttttttttttttttgtcttttaacagccaacagtttattgtacactagtcttgagcagcttcaatctgaattcatctccccaggacaggaagaagtcaggagatctcggggagacagagcttatatcctttcttattcagaactgccacaacccctatccctcaccagtcaggccccacatcacaccagtggcccagctggaattctaacatcagctaattcctttatattcttgtcgttcttgacattgccagaaaacgtaatctctcatgctttccaatcccaatagtgttttctctgggcctcctaacccccctctctgtccacaaatctccttttcagttgcaacccccatccaattttaaacaacttccacattttcaatactgaggttaatcattaattgagctgtaatgggtatgtgttgtctactaagtgttttggaaagtcactttgacacttatctaatattataggcatgcactcatccttcccatgacccttttccttccacatactttagaatgttcttccttgataggaatgtaagctctatgagggcatgtgtttttgttttattcactaatgtggatcaagtaaccatagcagcgcctctcgtatagtaggtattcaataaataagcattgaataaatgaatttaatgagcatacattcagcaaatatatggttatatgacaatatgacaatgaatgagtaaaataatattttcccttatggagtttacattctaatgtgtaaatgccggaagcctatgacaaacagacaataagcatgtaaacagatataattccatactctcattaatctatggggaaaataaatcacattagggaaatagagaatgactggtagaaagaattttggttattttagatagactggttaagacaattctccttggggaggcaaatctgggcagaatactgatgtgaggcaaaatgaagattttggacataaaaagacttgggaataggcaggagtaataaacagagaatataaagatcttgatatggcaaaatgttttatgcatttgagagaaagagtggttggagataatgttagggagatgaggaaaggccatgttgtacaggtcttacaggttacctatacctgggggtccctaacccctgggccttggacggataccagtaccggtctgtggcatattaaaaactgggtggcacagcaggaggtgagcagcgggctagcgagcattacctcctgagctccgcctcctgtcagatcagtggtggcattagattctcataggacaggaaccctattgtgaactgctcatgcaagggatctaggttgcactctccttatgataatctaatgcctgatgatctgaggtggaacagtttaatccccaaactatccccacactgtcccttcccacagaaaaattgtcttccttgaaaccagtccctggggccaaaaatattagggaccactgatctataggattttcattttatttaaatgtgatgtgaaagcatgggaaagtttggaaaagtctcatgatcttatttaggatgataaaatcatgaattaaaaagctacttggtggagagagaaagcaaagagaccagcaaggaggctattgtagcatcaagtgacaaatgatggtggattgagccagaatggtggcagtggagtggaatcaggttctggatattctttgaagatggatttgatatggtaagggaaggagaggaattaagaataggtcctagattcctcagctgagctgggaaaatccattttactattagtgtttcctcaggaagagaatgagctaatacatttggggaaaatattatcacttcctgaaaactgaaaagaaaatgatcattttttaaaaatctattgtatcctttgttttctcttaacgttcttttgtctcccagccttttattttgaaaaatgttaacttcaataagaatttgaaaaaaatagtacaaccatataccctttacctacgttcactaattattaacattttgctacatttgctttctctgtcttttcacatatacacacaaacacacacagtttttctctgaaatatttgaaagtatgttgcagacatcatgaaactgcactgctagtattttggtatatatttacacatatttactgagaacaagaagattttcttatagaaatacaagaccagagaaattttacatagctacagtgctttttttttaaaatttatctcccactatctctttatttatttatttatttatttattattatactttaagttttagggtatatgtgcacaatgtgcaggttagttacatatgtatacatgtgccatgctggtgcgctgcacccactaactcgtcatctagcattaggtatatctcccaatgctatccctcccccctccccccaccccacaacagtccccagagcgtgatgttccccttccagtgtccatgtgttctcattgttcaattcccacctatgagagagaatatgcgatgtttggttttttgttcttgtgatagtttactgagaatgatgatttccaatttcatccatgtccttacaaaggacatgaactcatcattttttatggctgcatagtattccatggtgtatatgtgccacattttcttaatccagtctatcattgttgggcatttgggttggttccaagtctttgctattgtgaataatgccgcaataaacatacgacacatgcatgtttatagcagtataatttgcaattacaaaacatggaaccagctcaaatgtccatcaatcaatgagtggataaagaaaatgtggtatatatgtatatataccatggaatacgactcagccataaaaaggaacaaaataatggcattcgcaacaacctggatggagttggagaccattatcataagtgaagtaactcaggaatggaaaaccaaacatcatatattctcactcataagtgggagctaagctatgaggatgcaaaggcataagaatgatacaatggactttggagatcaaggaaaagggtggtgggggtgggggataaaactctacacactgggtacagtgtacactgcccgggtgatgggtgcaccaaaattttagaaatcaccactaaagaacttattcatgtacaataaataaataaataaaaattaacagggggaaaattggtacatggaatgtcagggggccttaggcaacgctgccctggggcagaaccccctgctctcccaccaagacacagtgccctccccaaccctatcaagcagctggccctgaaggaacagtgtacacctgaggggcccaggcaggaggctggagcttagggcataggagaggagccaagaggttgtgaagacagagtagctgcaggggaggtgcagactccaccacctaaagggtgcctgcaggggcctgagagccaagaccaaggctctgcaccatggggtggcctcctgcatctcccgccatgtggactctgcacaggttggattatatcccttgaacctgaagagccgccttaacattttttgggattccatgtttgtgctgacaacaccaccccttccttccacaacactgggcatggtgcccaacttggaccatgggttgtcaatcaacgagtggatgatcagccctcaggccaagtcctcccacaccctgtgtttgtgaatacaatgttattgatcaaggcagtgcacattgatgaaactgttgtccacacctgccttcacgctgtaacagcagggatgagttgttgtgacagagaccatgtggtagcaaagcctgaaatatttaccctctagctctttacagaaaggattgtcaatcctgaggaaatcaacaggaaggaaactattccagtttctaaaaatgtgagtgttttgtgtggtgaaagagaccatacatttctaagagaaatgatagagacagactggagaaaatacttgcaacatatgcatttacaaaatttaataactcttggctgggcgtggtggctcatgcctataatcccagcactttgggaggccgaggcagctgaatcacttgaaccccggaggtggaggttgcggaaagccgagattgtgccactacactccagcctgggcaacagagcaagactccatctcaaaaaaaaaaaattaataactctaatattccaaggcttctacaaattaatgagaaaaaggcaaacacaataaaatagaaaaatagaaaaatgggcaaaggagttgaacagaaaaagcacaccaaatacaaatgatttatgaatttatgagagacaaatgtcataagttattaagaaaacagaaatgtcacagtgtttttcactcacattgatagtattgagtcttgataaggatgaagggaacgctgtgcctttgggagaagcatcaatgagcacacttgttttggagagggtaatctatctaaactaacactaaattttttaaaaatgcatatctttgctagatagtatcatttctagatgtctaatctatagaaataatcatacaagttcaaaaataaatacagaaggattgtcatcctatcattacatgagataacatttttttagagaaaacctgaacactaattaatggaaaatggttacataaattgtaatgcatacattttgtaaaataggcagttattaaaaggaatgaaatgcatcaatattttctaaatgtaataactactaagatatattgttgagtaaaaaagcaagttgaaaaacattatgaattgcatgattgcattctaaaacataaaatctgtgtgtgtgtatgtgtgtgcacatgtgtgtgtatgtgtgcatgtgtatgtgttctagggaaaggagcgatggccacctacctccttcactggtgtgtggtaggcagggttgctgctctataagctaagatattgatttggctgctttagcaaagatcaaaataacagtgacttaacaataaagaagtttggttctccctctcgttaaagtcttggattagtagaaaggccagaggtcaaagtttccagagtcctacctgtctcatcactgtgccattctgtcagtgcatctcagctccacacagttgcagctggaggaccatggcctgggcagcaggaagggggaatgtggaggaaaggacagataggctctgtggaaggcatgacccagagttctacatgtgatttaaatcaccttcttttggccaaaacatagtcatgtggccacaccacgtaggctgggaaaaaaagcagtccttggctaggcagccccatgcccagctaaaatgtagaggtatctgttattaaaagaaaaacagaagaagtcaatatttgggtataatgagtagtctcttcctatggatgtcctgctgtcttccttgccaacagaaaatcataaaatcgacaatggagaaacagcagacggattatgaaagaatgcaatttgtctatagcagacttatccacaacagtaacaggcaacagaagatggaaaattatatttgcaaagtaatgagagaaaccagtgtgagcatagcatcctacattatgcaaatgatcatttaagaggaagggaaagagaaaaacatttcagagcaagacagtgagaattggccaggcacggtggctcgtgcctttaatcccagcattttgggaggccaaagcaggaggattgcttgagcccaggagtttgagaccagcctgggcaacttggtgaaatcctgtctgtattaaaaacaaaacaaaacaaaacagaaaaaaaaaaaggtagtgagaatgtaccattaatagacatgtgctgaaagaactactaacagatgtactatatttcaagaagaaggaaattgaacacagaaggaactgaggtgcaagaagtaatggtatagaagaacactggaaatatatggtatttctagaaagctttagctgaatccatcagtaataataaacgtaatagttctgaatgtataaaagtaagttggaaatttccagctggaaaaagatggcttagactagttttccttgcaccttccctctacacacagctataaaccctagaataatgtaagaggcaaccaaaggagaactctcataggtgttaacaggaaagtgaactggtttgggcctcagggatggatgaagtgcagctgcagggaatcttatttccccttaccagatggaggacagtgacccaggtccagtgtttcccatccccaacacagtgacagaaggcagccaaggaatcctcattcctgtcctggaactacaggagtccctcctacagcaccaggtgtattcatcttctgttgttgctataacaaaattaccacaaacttagtggcttaagtaactacacatttattattttccagttgtggaggtcagaggtctcaaactggtctcactgggaaaaactcaaggtcttcagggctgtattccctttggagctctagggggggatccattcccttgtcatttccagctttagaggctgcccacactccttggctagtggccccttcctccatctccaagccagccacatcatgttgagtcctgctcattcttccatctcttattttctctctactgccttcaccttccattaacaagaactcttgtgattacattgtatgtttgtggttacactacagaatccaagatgacctccccatctcaaggtcaactaattaacaccttaattctatttgcaatctttgtcattaccataacatattcatgggttctgggataaggggtagacatttttatggaggcattagtctgcttaccacagactgccctctggcccccaaagatacacatctatcccatatgcaaaatgcattccactccaagattcccagccttatcaacccattaaagtaacaactcaaagtccaaaatctcatctaactttcagattagctccaaagtgccaaaatgcatcatccgaggctctgggagtgatccatcctggggcacaattcttcttcatctgtgaacctgggaaattcaagaaacaagttatctactcccaaaatacaaaggtgagacaggcatgggataacagtgatagatatttccattcaaaaagagaagaggaagaaaaaggagttgccagtcccaatcaatttcaaaatcaagccaggcacattccattttgtttcaaggcctgagaataattctctgtggctcaagactcagacccccctgagctagtggctctgcctttggagtcatccttcctttttcttgaagggtatcacatgtttacagctgagtagttttatcatcacattttttgcctgtagaatttgagagtggcgggggcggtctaacagccctttttcattttgctttctctctgtacttttctttccaagctagcagtgtttctgttggtataacatcctcaagagccttgtgagtctcccatgtttgtcacagggattcacaccattggataagagactcatctaaggatctttcatagagttcagtgccacctgcaagggagatataccaggatcccaccatcaataagtgggcaagagaagtcctcacctcctctgcagcctgaaactcccctctcccatcaagaaacagcaggccaggtggagaaggcactggcagagggcatcctgtcataagtacctcctctgggaagactctctgtgccctataagcagaagagatcctgtcacaagggcccagcttggaaagcctctgtttttgtgtgggcctgggtcttcccaccccactgagtgacaccaggccaacaaacctagggaaataccttcagccctctgggcagcaacagcagggaccagtgaagagcctagcagcaccagctaaaccaaacaggtgaaaatgacaccacaaagtttctgaaaattaaactgttattggaaccatggcccacaaaagtaggtcattactcacatactaagccttaacagggtgattgccttgctacaatagaaaatttaaatagaaatcagtctcctaacagaagaaacaaaatgtccagaatacaataacataccaagaaacaggaaagcaacaacttgaatgagaaaagacaatcgaataatatcaacatggagacgaattaggtattgaaatattctggctaggactttacaggaaccatcataaaaatgcttcaaaaattaattacaggggccgggcaggtggctcacacctgtaatcccagaactttgggaggccgaggcaggcggatcacctgaggtcaggagttcgagaccagcctggccaatgtggtgaaaccccatctctactgaaaatgcaaaaattagcctggcatggtggcaggtgcctgtaatctcagctactcaggagggtgaggcgggagaacctcttgaacccaggaggcagaggttgcagtgagcagagatcatgccactgcactccagcctgggtgacaagagggaaacttcatctcaaaaaaaaaaaattaattacaaatgaaaaaatagaaaatatcagcaaaaagtagaagttacaaatttgttgggttaaattacattaatagattttatgatgtagaaccatcatttattttattgtaaaaatacaataaaataaattaaaaacttgctggatgagctcaatggtagaatggaagtgacaaagcataaaatctgtgaatatgagaacagatcaatagcacttgctcatcatgtgaataacatcattaagaataacagaaaaaaaatcatctgaaaaaaatgaacagagcctcagggaccttgttagagtaaaaaaaaaaatctgacttccatactatcagagcctaataagaagagaagaaagagttgaaagaatatttgaagaaataattcccattttgatgaaagatataaatctacagattcaagaaactatgataatcacaaacaagataaacccaaagaaatccataccaagacacatcatcattaacttaataaaactaaagacaaaaaaaattgaaaacagccagaagaaatgacatcttaacctacaagtgtcatttgaataagagtggatttcttatttgaaaccatggatgataaatatcttataaaacataaagtagaacatattttacatagactatagtctcttataaaaataaaatataaaagaaaaatctctttgcactcccatgttcaagggtggaagaagagggatgtcccaggggagggaaggaggaagagaatttgcccttctcccacctttttgttctatcaggtcctcaacagatgggaagatgcccatccacattggtgagggtagatctttactcagtccaccacttcaaatgccaatctcttctagaagaactctcacagacacactcagaaataatgtgttaccagccatcagggcatgttttaggccagtcaagttgacacataaaattagccatcactgtgtacttttcctgccctggtctttgatttggcctagtggtgatagggaatttagaaccccagatccagtctctagctgtgctcattgctcctggagcaccatgcttctggctctttcagaacagaagtagaaaatatatgagtttttcatttgtttgctttttaaatctatcctgttccctcaaattctaaccaacaccacagtactcttccggtcttagagcttcaaacttatgtttgttttatctgaattccttcctcaggaaaggaccctcaggcctgtcaacgaaagtatcaaagaactgaaactcacaaaatcaccacatcctgataatgagatgccagacccctcattcatcatgattgcttccttaacctctctaattcctgttttcttatacattattacatttcttcccaggtatataaacctttaattttggtgggtcaggcagaaggatttgagactgaactctcatttccttggctacctcagtgattggctgtgcagcaagcagcaggacctcagtggacccctggtgttttggtaacataatcacatcatatttctccttcaatttattgggttaagttacattaatagattttatgatgtagaaccatccttacattcttgcaataaactgtattagttgtgaattggtggattcgactaatatttcattcaggtttataaataaaatgtctgtaattatcacttctgatgttgttcttaactggttttggaatcaaaacaatgttcactttttagaatgaacttgaagacgttatctcttttggtatattttggaacaacttgcttaacttgaacatttgtatataatttgaaaattttgtaaaatttaccttcaaaaccattttggcctggggttgtttgtttgaggggttgacggaaggcagagcttggactattacaactgtattaatgtttcctggtttacctgttccaatttttttcttcttatgcagttttggttttctatatttttataagattttattcattgaattgagggcttcaatttttcatttacaataaaattctcctttacaatttttaaaaatctccactgtgtttgcagttattatctctttttgttctgtatttcctctcatagtttacttttatgatcatcttttttccttggtgagtcttgtgagatgtgtctgtcttgttaattttttcaatgactttatttctgccttcgttaatcttctccattgttttgattgatgtgtgccctgatggttattatctccttttgtgtggttttttttttttttttggttttactttgttgctcttattccaactcttgagttgaatgctagtttgtttttaaaaattgtattttctgaaaaatggtcttaaagctataattctccttctaacaattgctttattggcagtctgtgtttttattatcatttagttttaaatattccgcaacttccttttaaatccaagagtgattttgtaaaatgctatttatttccaaaaaaaaaaattggattaaaaatctcttttgggccaggcacagtggcagcactttgggaggccaaggcaggtggatcatgaggtcaagagattgagcccatcctggccaacatggcgaaagcccatctctactaaaaatataaaaattagctgggcatggtggcacatgcttgtagtcccagctactcgggaggctgaggcaggagaattgcttgaacccgggaggcggaggttgcagtgagctgagattgcaccactgcactccagcctggtgacagagtgagactccatctcaaaaacaaaacaaaacaaaaaaactcttttgttgttttagttgtattatatttaggaaacatgctttgtgtgaaattcatcctttggaatttaagagagctttccctatgttctaatgcatggtcaatttttgtacatgttccttgattgccctaatttaatgtgtattacctattttggggggtttagagttctttatatatctattaattatagtgatcagaccttgatacgcatgctaattttttggtctgttttatccataagtttctaaagcagtatgttaaaatatcctactataattattgattcttctatttatatctataattttttcagttgttaccttacatattttgttgctataattgtggggacacaatttcatgatgttgatgtgtatattttgtatttcttttaagtagtttaaatatcattattctggaaattttatcctaaattttattagaaacatacttcattgtttctaagtcaagatttttacaaattctggcatctctaaaactgagttgctgagttgctaattaatgaggataaagttctagttaaacaaaatgaataagttctagagatctgctatacaacattgtaacctatctttaactataccctattgagccataatccagccactgtactccagcctggcccacagagcaagaccctgtctctaaaaaccaacaataactacaacaacaacattgtattgtacactttaaaatgtgttaagatggtatatttcatgttaagtgttcttatcataataaaataaaatttcaaagtaaaattgagttgtttcttttacctgctgtctgggaggcagtagatgtgacctaggtgttattgcctgtgtttatgtgaacataatgataactgttctttttgtcattacttcaattgagttctgtgcatttttggcactagatgtgctgaatttaattgctgtttataatttatttaaaagcttacatgatgatttggcattgaagtgaaaagttatatcgtaagcagaaaattaactataagaggctagtgtgacctatttatatgtcatgcaggactatagtcaaggtatcaaatatcgatttgtcagaaacttgctgctgactttgatctgaagctatttaacttctaagaacatatgattccactgaggaaaaaaatgaagctatgaatgaaataaaaaatgaaatactaataaaactgagtttttacagaacaattgctaaaggtgcttattatgaacacaggttagaaaaatattacatcactctgatgctatgcataatcaccaaaggtcaaatgttgttaccatatttaattttaaaccacaaacaataacaaaatgtaagttatttcccaaaatatcttattgtgcttgcactaaaaagaagaaaaaggcattagataaactgatgacagaataattaaaagaggctgggcgcggtggctcaagcctataatcccagcactttgggaggccgaggcaggtagatcacctgaggtcaggagttacagaccagcctggccaacatggtgaaaccctgagtctacgaaaaatacaaacaatagctgggcatggtggtgggtgcctataatcccagctactcaggaggctgaggcaggagaatcacttgaacctaagaagcagaggttgcagtgagccaagatcgcaccattgctttctgggcaagagagtgagactctgtctcaaaaaaaaaaagaaaaaaaactcaaagaatctggaatggatgtctaggagactaagtaactaagcatatttgttttgatgtatctgatcagctaaagaataagttcactaagaagtgaattaggttggtggttgttccataatgtatgactccttgaagattccatcagcaaaccatttaacacttatttgaagaaggaacacgatttctgtttgttgtctgaaaaccttgcactgattgcaagttctggtaagatcactaaagcactggcatcaacttaaaaatggcatccatgtcttgaaagaaaaaaaaatctcagacaacattgaagcactcttaaacagtgcttcatcacaaattctatcattatcacagagggcatttgagtatgctcaaaagcttgggtaactgactgtgagtgaaaaagtaattcaaaagaattatattctgatttggaaaagtttgttttccttttatatattagggctatctatttccagaatttttaatttaattttactttaatttttttagacaaagtctcactctgtcacccaggctagagtgcagtggcacaatctcggctcactgcaacctctgtctcccaggttcaaatgattctcttgcctcagcctcctgtgtagctgggactacaggtacccaccatcatgtccggctaatttttgtatttttaatagagacagggtttcaccatgtttgctagtctggtctcaagtgatccacctgccttcacctcccaaagtgctgggattacaggctagagttttatttttaattctaccgtctctttaagtttcttctggagaccacatactgttggatatgtttttgtttcaaattctgagagtctcagccttttaattgttggatttaacccatttatattttgtaatttctgttatattagtgattatttcttccaacttcatatttacatttactttttcccattatattcttttattgatttaaaagttataactataatttatgttctatgacagttgccttaatttaatatccaaatatatgtttatttgcttcttttattttcttaagcaaatattaatatatacatttttcccttaacaataaaagtatttttgatgcttattatacccttggcctctctttcttgctctctcaatccctgtcatattgatattatttaaaattttagttcttggttgccatatatgtttttttcttttctttggtcttagagtgagggcgtttgtacttttcttccctcctaaggcaagggtaacacttgctgattcatctgaggatgcttattgcccatacctcccgtattatccttctgaatctgtagctcctcttttttatgtactttccttgaaaatattttaaatgtgagtctttgttgatctttgtgtggcaagcctgatactctaaatgcctgagcacattttaaatatatacttaggttttaatgaaaaattggagataaaaatttcagtttcaaaatttttattttcaatactttaaaatatttctcagttgttctattgcttccaatgttgtgtttgagaagtttgatgccaatttgattcttattcctttgtaagtgctctctgcaagcatttagaattttccctgtctcctaaatgttttaaattcactgtaatgtatctgggtgtgtctttttctttatgttttctgtttgagccctatttgtctttatttctgggacattcatctttgcttttattcaaatatttctttttctccctctttctctttttcttttgagactccatttacccctaccctttggatattggcacttctatatctatcttccatatcttttatcttatttcacagttttaatctctttattctttcctgccctctgaagtgttctcagccttcactctcaattccctaacctgcttctcagctctggctcactctagaaggcccatgtcaatagacctgtccgtggttttctaacttttaccatcacacatagcactgcagtgaataacctgcacatgtgaaaggatctctataggataaatgcccaaaatttgaattgtgagtcaaaggacatctgaatttctaatttctgataggtaaatttttctccacagtggtggaccgaattacactccacccagcaatgtgtaagagtgtggtttcttttacattttcctaatgatgaattgtgttgaacattgtttcacgtgtttattgaccatctgcatatcttctttggtgatatctattcgagtcctttgcccattaaaaacattgagttgtcattttgttattgggttgttaattcatattttctacttaattgttgcttttatacgtgaaaagctgtgggtctcaatattaattttgttcattgctactgtagtaaattttcttattatttgttgtactttttcactgtgttggatttttcaggcatgcaatcatgttatctgcaaataggctagctcctctttactgctgtttctcttgtctataatactcgtgttggctggtacctctaatgcaatgttaaataacaatggttacaggagacattctcgttttgtttctgacactctcaggaatccttctaatgatgtgaatttgcggactggaatagatttatattgataatgctatgaagtattagtctatattggcttatttaagatattaaaatcagactagatttaagttttctatggtctatggaactgatcatatgacttatctctttagagccaatgattttgtgaattatattaatttcctgacattcagtcatcctattattcctggaataaattctgcatagtcataaggaacacattcttattctaaggcattgttatattctgtttcctaatattttatttaagatttttaaattggaattaataagcaaaattggtgtgtatcttccttttctgtgtctatactccctgccaaatttcaatgttacttttatgtcacagaaaacatttagaagtttttctcatttttcaatgttttgtagcagtttaaaaaacacagaaaatgtctgttatttattaaagacaatgtaaattcccttataacattatcaaaggctattctggagactagcttattgacaactatattagtctgctggggttgtcataacaaagtatcacaaactaagtggcttaaacaacagaaatttattgtcttacagttctggaggccggaagttgagatcaaggtgtcagcagggctgtgctctgcggagaatgctggggaaggatctgtccaggactctctccgcttctggtggttccttggcatgtggcagcatcactccaatcagcatgtggcatcctccctgtgtgcctgggtctgtgtccagacttccccttttcagaaggacaccagctgtgttgaatgacagcccacctggctccagtgtgacctcattctaacttaactaacatctgcaatgaccctgtttccaaatgaggtcacaatctgagggactggggcttaggacttcaacgcaggaattcgggggcatacaattcaacccagaacaacaaccttatccatgtcttcactctatttaaacttcctaactcttttggagctcgttgtgataagttatatttttctaagaaactatccatttgttaaatgttttcaaatatagctgaataaaatggatcaagttaatctttatgattttattttctgttgctttttcctctgcaaaaataaataattaatttttaatttttgtttctggttatttctcccttattgttttttctttgtggtgtttaaaaagctattttgcttatattatttagcagtttacacattccaccccaccccatcccccaaccatgaacttttgtatttatttctcaattgtactgttttttccccaaatcactgatttatatttttctttgttaatgcttcctttatgctttctttcagtttatttttctttaaatgactaaatgtacttattttaaaataattatacagtaaaattgacattttttactctttgaaggtaaagtccatgaattataacatatatacattcatgtgactactgccatcaccacggtacacagttgttctatgacctaaaaagaaaacccccaaacaagaaaacttcgtgtgctgttgacacgcttgcccggtcccggccccatcccccactgatctcctttgctgtcattctgttctcccccactgtagttttgtcttttgggcaatctcatgctaatagaatcatcccgtatataaactttggagaccactactctcacaagcacagtgcctttgagattcattcagattgttctgggtgtccatacaggccagtctctgtggggctgctgcacaccacaccccctccccaccagcccacctctgagtgggccaagggcccagggtctatttcctgatagaaatctcaagcaacaagagtaattcctgacaagtgcccatttccttccctcatgacaagatgcacaatttatcttccgggaaggaacgcccagcctttggcataactttcttaagactcccaatctgctaattcatttcaagagaaaggaaaaaccctttgtttccaggtgagtgctgggagtgtggtatgatggggattcttcagacccaggaagtgacctggccaagggtcccctggtcttctccatccttccttccccaggttgccccctgctctctgacccccttcgcctgattccagctgtgtttttagtgctccctgatgttcctgcaccctgagaccctcaaccaccccacagtacaacagctcctgacacaccccgcagggcttttccatttttaggtggctcaaccctgctgcagcttttaactctgctagccagcaatttttttttcttttctttttttttttttttgagatggagtcttgctctcttgcctggagtgcagtggcacgatctcggctcattgcaagctctgcctcctgggttcacaccattctcctgcctcagcctcccgaatagctgggactacaggcgcccaccacctcgcccggctaattttttgtatttttagtagagacggggtttcaccatgttagccaggatggtatcgatctcctgacctcatgatacacctgcgtcggcctcccaaagtgctgggattacaggcgtgagccatcgcgcctggcttttttttgtttgtttgtttgttttaccacaaatgtcatacaggctggttgcaagaaaatgcaagtaacacataaatatattaagtaaaatataaattgtgctttcactgcctgcctccaacaccaaggtccatttcagaggtgaccactctttatggacagcttgagatatgtgcttccagattgttttgtgtgcatctgcaaagacacacacacacacacatccctcacacacgtgttcacacatacccctgtacttctgtagtagactcttggtgctgtgtagattttcttcatctggctggtgcatccttcccagctgcaccctactctggagactcaaccagggcagaagcaatctgtctcatccagaaatgtctggaagtggtacccagcccgtagagcagcccctagtcagccactgagtaatacaggcacaaaatccccgcccccttgcttggaggtggggccgctctgtggtagctttcgcattccagagctcccctgggaccaggctgaggcttccactggatcccttgcccggcttctcccctgcccttctaagcttcccctgagagcactttctcagcaaatctcttgcacataggcctgtgtaataggtatgcataggcacacgtagctgttctcagagaggagctcctgctcactgaagcagagggtggtgtctttcttcacatgacagcaccccatggccacctctgaatgtgagtctacttcactttcttatggcagcagagctccccctggaattgattaatagccctattagtgagattgagctcattcattcattagacacatggtttatgaagtgctactgtatgccaagtactgctttaagcactggggctgtctccaacttttctctcttacagaagatcggaatatttttaaagcatattcaagcatttgtgtaaatggttctgaagcacagattcctggagatggaattgtgggtcagagggaaactgcatttgcagccaggatgggtgtctcttggggaagtgttcctccttcagctccagcgacagctccttgctttgtgtctacttttctcccccatctctgccttggcaacctctcctccccagcccttcccacctacccagggaacacctgaaaccctggcagagctgctgctgagccctcccccatgctgctgatctgggcatttgcccttcctgctgcctcaggccctcagaaaccaaggcctcccagcctgtcttctctctggtccctggtttacggaagaggatgttgggattcagagaggttaagtgacctacttttctagaccaatttgttcaagttcctcccaaacatctccaccagcctgtcccagaggcacttcaaattcagcatcctggattattctcttcatgtctgccctaaaacttgccttttctgttccctataataaatgcccaagagaaaatgtcccatgacagctgactctcccacccctccttgtcaggcacaggtctcctgagctctcctgagcctgtctcctgggtctgccattgtgactgtcccctgcagccctgatctggatttgtggccaccagctcccttactgcttccaccagctggacatccttggtcctcacaggccctggagagttcatcttccagggctgctgtcagcatccccccttggctcaagcagcccgccggggactcaggagggccggtggcaccagaggccagcgcagtccgactcaggtcattccatgcaggcgcctttcaggtcctcaggacctggggaccagcaccacacacagctgtgggtcctctcgagccaataccatgtctcagcccctgtagcctgccccgtgctgccctcctcttacctcgcaggacctcctttcttggccccctggatagctgcctcttcctttccaggacagcctgggactctgggatttgccaatatatgtgtggggcatcagaggagctgagtgctgcctgtgaagggcattgacgacgtgtcggggaaatgggaaaggatgggagggtagacatccgggttggtgtcctagagatccaagacgcgcagctcaccatgctgcttgccttcaggtgcctcattggtaagtcaaaggcaacagatagaggctcccagaaggcccttcccagagagcaactctttagagatctaagcatcttcggagaaaatttgggagcttggatggtttgtatcaggcctctgttttttcttggactcttttgggtatcttcatgcccctcgagtgcttatcaggatgccacacggcacagcaggtggtgaatatatgtgtcataagtgagcgagaagcaaggcttttcatcagggaaagtatgacttctctgatggagcaatgtcactccattttacttacctgcaggaatgtttaacacgagagtgaccaggacactgcaagtggctgtgttagttggtaaaccttttcagaggacagtttagtaatccatatggaaagttctaaaattatgcaatgcctttaattttacttactgaaattctaaagaaataattaaggatgtgtgtaagatttagtggaaggttgatctttgcaagggctatttataataaagttgaaaacaacctgtgtccaataacaggagattggttaactaagttctggaacttagatacaatggaattctgagtagccactaaaaattatgttattgaagtatatttcgggtgtgggaaaaaagtcgtaataagttactgaattgagtcatgttataaaatagtatgtacttaatggaaacattttagaacaaaaatgtatatgctacacatttttaaacatctgtgagggtcttgctactcaaagtgtggtccccggaccagctgtttctgcatcattgggagcttgtcagaatcacagaactgcagcccagcacaacctcaggtgattcccatgcagagaggtcccaacgctgggttgcggcacccacacaaacatcacatctgtgtgtggggctactaggagtctattatttcccctttttgcttatttatttgtggcaactgtatgttactgacataataaagaaaaaagaaagatggacacactctgaaaaacacacagtgggcttcattgtcatggaagctttcctggctctttcctgtctgggacgccctcactgagttcactttaagtcccgctccttcttgggtgcatttgactctggtatggggggctcttggcttgaagagtggcactttcagaatcactgctgctttcaaaggggctctgctcctgccagacagggtggagactgaaggcccaagggccttcggtcccccagaccccacccagggcatgggccaggccccttgcttgccctcccactctgccgcatggtctgcccattaggatgcaggccgcttggcagattaggtcatttcttttccagtaagtgaattggctacttatgcattctcctgtagcaccaacaccagacacatttctcaatcctcctcccctggtaggacaaggccaggaacagactgtttccaccttccttacatcaatctgtcaggctgcggcaggtggctctgctggaaggccactgccctcgtccctggctgtccagaaaagtgtctttccccagttccagtgacgtcaggtggatgctgcacctgcagaggagagcagctgtctctgaagctggccctcgggtgacaaccccacaggcgatggtgagagcgaatgacgcttgtggctctcagagtgtggattacatgtggcaggccaaggtcttcgaagctctgaaataagcaagatcttctccccccaggcaaagcatagactaagccctgctctttcttccagttgagcaaggaggatccagaggctggggatgggttcccatctgacttggttctgaagcccatatcctgggagtagagttgccagcatggtgcctgaatatggtgtatggtttcccatgatcaagggtgaccaaagttttaaagacccaagaaagtgctgagtccagtggcctgatttcacttgctttattttttgctgagtactgaccttccgtcagggtttagggccaacttgtgtaggtagggtgtggggaggtccgcacctcgaggagcccagcatgggtgtggggggctcgtgctggctggttgcatccgtgcctgagctcagccttcttacacctttgcccatgaataccaccccctgcccccgcaccctcattttcagaaggtcccacccaggaaaggggaggtgccaccagctatggtttgggacaagctgggccctgcaaccagtgcttatagtggggagggggtggggagcgcaggggaaggcatgggtcacagtgtaccccatacctacccagccctctgcctccttcacctttgtcaccccactgtgtagttgtcacctgttcccaccgcgtctcccacatggcccctgtcagcctagggatcagcctgctatcagcacctgccgcctagtcctagccgcccactccaggggcctcctgctgcacttgcccttctcagagcagccactaccctgcagacctgaccagggtggagcatgtacagcctgcaccattgggaagacctggtgaggctcaagctgaattattctacatgctttcctgtgagttccaaaaatgtctgaaaaaactgaagaacacattgagagtcctcagccactcctctctcctccgtggatgcatttatttcactgtcttttctttccttcctgtctctgtttctcatggaggatgctgtgtcggccctcaatactgggggctcactgaccttcctccagcctcattcattcctcagatgagcagtcctgtctcagggctgaactcccctctccattaaattcctgcttctaaggagcccccagactggatcaggggctaccacattcacccacctctggcagcctgtacacatggatgcaataatcctggaagttcccaagaaggaaacccccactgtgtgttctcccaggcctcctggggtgcttcctagagcaggtgggaggagcaggaaaagtggcttcaccagcatctcttgatggctgttgatagaaatgttatgcagacgggtgggagtggggagggatacagagccaacgaggcccagcactctcctgagggctaatcttcggagtccctggcaggaggcagggagcaagtaatgaaggagcaacgcccagcaggagggagtcatcggactggagaccaagaaaggcccaaggaggcactcaaatgctgaaggaataaatggtgggctctggactttagttagcattccttacaatgtgttagacgagaaagggtctgggttcaaataggctaagaagtactgctcgcccccagttaaatgtgttcatctgttgcagagcctctcagagcctctctgttcattttcatcagaattgagaggaaaagttggcagtgagtaaagggagctgggaggcgacacgaggaaaggactttgtgggtcattgatccattgacccctctcctgtaaactctgcctgcatggccatcactcaaggacagctgaagggtggcctggaagggcctggaggaaaggtggtcattggggtggaacccaggacagtggctgtgaggatgtgggaggtgggtggccagtggtcaggacagggttctcccttggataaggcctgggccctgcgtggtcaccgtgatcagggcgggccagggcaccttgaagtaaggcaggacaaggaggcccggaggccatgagctgtgggagggacctgcgctcccccagggcttgcagagcactaggtgggcaaacctggccgaggcctcactgtggccctgtcctttggttctgggtatccctggcctttcccgggagggagaagcagcagcagattgtcctacctcggacatagcgggctccttccttccaggggcctgactgacctggcggcactcggggtagcctgctgggcgttgactcttgtcggctcctagccctggtctcctgggcaaacccctgcaccaaaagaagaaaggcccccaccagctccatcctaatctcgacccgcttgtctgcaagaggctaaaggagcctactcgactctcattctctgattttctgtcctcccctaaaacctcaggctcatccctggctccaagcccttcatcttctgctcttattgcctcccggcgcccgggattttgggctttctaacgccctccgcagcctgccaattctctatcacctaaggctgaagaactgcgtttgtgaagagggagtgcatggggccggggcggggctcccgtggagagggcggggcctcctgcggagggcgtggcctgagtgtagggtcgggggctgtgggcggggcggggcggggtctgagggccctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccaccaccgtttgcatatgggcctttccattaagaatcacgcgctccgggcagggccagcgcgctgcgggcagctccctaagaccccgacgggcgtaagcctctctgcctctctgtccagtctggcctgggacagacacctgtggacacctgaggcaaagggaagtcggggcccagggacatctcaggggaatagggtctcgggaaaaagggagaggctgggctacgaaggggagctggggtaggcaggggagcacagccctgcaggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcctcccccggccttttcagcggccgtccagagctcagcatcagcgctcctggcacagaccccactgctgactccattcactcccctacccccccttaagctatttgaacttctcacgccctccacctgcagggccgggttatgtcaccggctgacgtcaacagctgtagaggaataggagcaggtttccgttttcctctcccggcacctggccaaatgcccagatatgcacccactccctactgctgcctccttatggctgcccaccagccccactgagatcgaatggggagcctgtaaatcctgatgtcacccagtctcggggccgggagaagctctgagccaggcccccaaacctggcagggtccagggctgggggcaggtcaggggcctagcctgttctcctgctgcctgccatggctggctccaaggagggtggaggccacactccacacacttctgtcacccagcaggctctctggcctcagctcccactgggcttggacagtgggagcaccagcagggttcagagccacctggaagcagctcactctccaggtcccaccccatctgggagcagctctctccccaggtacccccgcggcagccgtgggggtggccttctctaccaaagcctgctccttgctcctgccagggccgtctctaaggcgacagccacacctgctgttgtcccatcaggcctcaaagaggtcacgtttccctgtcctttccagtctcctaagccccacttacgcctctaaacagactctaccgatgccccaggtcagtgttggggtcctggctggtgcagctggtgggtgtttgctctccttgaattcattctagtctttgacaagcatgcattgagcacctgttgtgtacactaggcctgtttaggtgccaggacaggaggagtatgacttgggtcctggcctgtgagaggccagggcaaaagcagtggggaggaggaagtggtggggagatttagggccccatgtgatccccagtaccccaattcatgtcccaaaacgaaaaaaaatggtaactcttggccatgttgtgcaatagtccctaatcagcaatgtcagctgaggacacgtccggtccacattatatttaatgatggtctagcactgtcattacccattttttaacaagatggccaagaaagccacccttgagggcaccagattgtcttcctgctgtttctgtcatgctctgcttctgcacacaggagacacactcacaggcaacatgcagacacacatacatgggagacacacagacacacacacacacacacacacacacagaggagcgaagcaggaactagaggctggccagctctacctcttctccaccaacatgttttgagtcccctcggacaaatcaggccccataaggtatggggtctccctccctggtggaggtcacctaggtggttcagtcaaagcccccagtggtggacaggccgagagcaaagaggcttctcttggtccctgtcactcctccctcctacactctcctttcccccttggccccaaagaccaaaccatctcttggactcagaggcctgtgaggtctcctgggggtctccaggcctggatgcacccagctgcttctcctgggcaccgaggctcccggcacgccccctgtgactgggctctcatctcatcttcacctccgtgtcgttcagcttgccctccacccatgctggtcctactggccatggaaagccgctgctgcaagacatccttcagtgactgtcctggctttgtgtccatgcccagacttagggggaaggggagaagcaccaagtcttcagcacagagtcagtgaggggagaggaggtgcttccagtggttggaaacgttcgatttctttttaagagtaagttttagctgataaattccactcccgtcgatatctttttccagagaacacctacggagataaggaggtgtgccccaccctgaggggctcggggagagagaacaagcaggaggctcagcttccccatctttgtgtcaacagccccttcagctctgccatcctttgtctaaactcactctcccgcactagagcacactgtcctagggggtgctgtgtctgctccccctacctaggtcccctgcaccccaccccacacccccacctgctgaatgaatgaattcagcaagtgaatgaacaagtaaatacccaatatttccttgcacaccttgcactttgcagaaaagagttgggtgggggcagttttaattcttctgtgctctctctttccatctataaatccctacccttgaccacctgggccatcctcacacagcccagggacacacacagggctggctgtcattcttgatacccttcccattgtatccttcctgtccagtggaccccctcaaaagacaggaaaatgactgtgaccactatgtaaatagggagagatgccttcaggagtcactgctgccttcaggagagaccagcacccatggaaaggagccctaaggtctctacgggtgtctgttttcatttggacaagtagcttgatgaatgcggacatgcagtggtaggttggaagtagaggcaagagcggggctgaaaagagtggacctgtctggaaagaagtatgggaacatcgggcatctcttggaacactgcaggaaggtgcaggaaggaacagcacagagcggcagcctcagcaggagcaggaggccactgtccactgagcaccttcaggtgtttgccaaagtgcaacatgcacccttccccgaaggctgcctcacactcggccttggagctccacggtgggatttggggaacacagagacgtccacagtgaaacgactccatgaactcagctggcagcaataggagcttcagatcacaggtgaccaggagaatacgtgcccctcaaggactatacaaacctgggggaggtgctgggttttccacaattccacccgacctgtaccctgggacacctgggagaccatagggaagtgggtgctagtgaggctactgttgctgccccccaggcccgtggtgagggcagggtgcaccatcacagccgttggccccattggcagagcacactcatatcaccccctgctgcttacaccagccttgtctgtactcaggaatagggacagcaatcgttcccattttatagatggaaatctgtgtcctgcggagaggacataattgactgtacctagtaagtggtgctattagggctgttactcggacccctgtcctgagcctggacttcctcctgccaggcttggagaaccccatcagcccacccctgcaggaaccaccagctccacactggcttcctaacccacaagcatcgccaaatgtccatccccccgccccggaaaacattcagttgcatctctatcttatacccttcacaaaatacattttgggtggactaattctcacatgcaacatccacagttgcctttatctaagtcttagagtcaaaaacaagaggataagtttataaacttaggttaagaatcttcttaattagcacacaaaaatcaataaatgaaaatagtgataaacttgacttcaccaaaatgaaaattttccgtatgataaaagattccacaaacaagcttgaagtctttctaccaaatggagaaataatttgccatgcgtacaagtggccagaaaatacaaacaagtcctaccaaccagtaggaaaagactaacaatgcagcgtgaggcacaggccaagaagaacaagggcaagcgcaaacacaaggtgggaggtgggcaagctcaccacggccatggccatggccactgagggatcctgagccacgcccaggtcagcactaagtttccatcagctggcaaatgttttgagttcataacacctgggaagggtgcaggagtggggagcaggtgttttcttcattgccagggattgtaaaggggtggagctgccctggggcttccaggcagtgcttactgatgtgccactcatgcacccaggagctggcacttccatcctcagactcccccaaggctcccccagtatacatgagagcaggtacacagatgcccagcagcactgcctgggaccctgcgtgaaaactgaaaggtctagaagcaaatgaaaataccatttgtaagaaaatggtaaaaggaaactatgtgcctatgtttgcgcacgtgcatgtgtgcgtttgtgtgtgtgcatccatgtgtgtacgcccatgccatggaatacaatgctgcaatgaggtggacaacgtctacaatgaggtagacaacgtctacaatgaggtagacacaggatgatctccaaggtcagtgaaaatgttccgtgcacaccagacccactgctcttggaatcaagataaacccactccctgccttccaggccctccctggcccctccttcactgcctgcccttgcccccagcccagctcctgggccctctgctctcctatggcctttctctgacctctcatccacctcaaggctgccacgcatccttcactctgttctccccactggagccggccctgaggccgcttcccaaagcagcctttgctaaccactgcccctcaatgtgcaccatgctcctcgctgaggtgagacaggtgcccaggggccctgtctgatcacatgctgctcgcacagcatgctctcctagctggcacctgggaggtggtgaacctgcatgaacatcagctagacggctaagtggtggcacatagattcggtgtcgtgtaaatgagaggcacagaaagcggtgctctgggctgggggcagggggtggctcacgcctgtaatctcagcactttgggaggccgaggcagtcagatcacaaagtcaagagatcaagtccatcttggtcaacatggtgaaacccactaaaaatacaaaaattagctgggcatggtggcacgtgcctgtaatcccagccactcgggaggctgaggcaggagaatcgcttgaatctgggaggcggaggttgcagtgagccgagatcgcgctactgcactccagcctggtgacagagtgagactcctcaaaaaaagaaaatgaaagaaaaagaaagcagcactctgtgtttctgtgggcacgacctgtgggctcatgcgctcaggaggctctagaggcactgacactcatctccgcccatgcctcctctggcctcatggacggtggcaaagtggaaacaattttaatcaaggtctgtatttttaacaaaaaatgtattaatgacttcggattcttaggacttgtgatttttcacctttacactggtgtgaccgcaatatgcactcggtagaacacgaacttcagatttggtgatatgcaatacaatgatcccttcagatgctgggcagtggcgtgagcacagctctcggccaacatatgactgcaggccaaacagctgctactccaggacgctgtggcgctggctgattctgcccaactgtaggtgaaagtgagtgctccaagcgcgcttaagcgggctgggctcagctgtgatgcttgctagattgggtggattaaatgcactctcaactcaccttattttcaacatatgatgagtttatcaggatgtaaccccctcaaagttgaggagcacctgtacagtaaatgaaaatataatgaggaaaagattctcctgctcagtcgctgtttactgaggtatgatctggggcgggaaactgggcttcagccctccaccacggccacccagagggccctccttgagcatagagaggggcttctcatcgggaaaggcaggggagacttcccgggtgacgctgagcagaaaccaataggcaggcaagacacaggcaggggtggcacgggaaggagagaggtggtcccagccgagggggagcgcaggaaaaccccagagatggaggaaaccaacgtgccctgcctcctgccctggatggagaggcccaggccctgaccaccaaggcaacaaaggcctggcccagcgcgtgcggccagaacttccacccctgtgcatctgtgagggatggaatctggagcaggacctttacaggaacccctgttcctctcaggaagggacttggggcttcctaggttgtctacaatccccagagcatccctttctcatgactgccatggccccacttggcacaggcctcagcctccttcccggtgctctgcggcctttcagccccttctccccttctgggccccctccagacttcagtgggtctggagacaataagaatttcctaattccaggctgcgggtgatggatgcagcccaccaggcccctgccacggggtcttcaggaagccatctcccttctccttggactctgtaattaaagctggggataacctactgtatttcctaattagcagccttaatccctcatgcacaccattaacaggctggcgcatctttagatgtgattggtaatgtcgttagcctaatccataatcaatacttggataattgcttccttgggtttatatttagtccttggggtcttgggctggggggaacatccatctgcagatgcactaatggctgtgtggaggtcgcccacggaccgctcacccaggacccccaggagctgtggcctgtggtcagagcaggtgctgccacagcaccggagacccaggccctggtgcatccagggatctctgcaggctgcggttgcgaagcctcctggtccatcaaggccttgggctctggttccagaacactaggggttatttcagaaacaaggtcaggagaccccagacctcagacctcagaccatggcagtgtccgcacgtccccaccccacacatccccaccctttcagaagagtctgcggggggtacagaggatggtcccagactagagctgcaggactgtcacagcctgcacattcctgctccacgcgggccccagcgcccctcagctccaggcacagcccctgtcctcgcctcccccgcttgccaggaaaccgtggcccagcccgacgtgatttcctttctctcaaaggctggcggcagctttggcagctcaaggacaggccagggcagaagaagagcagcctgtcgaaggcagcccttatgaatgggatctcatctgactgtaactggaattcgtatggaggctccgcttacaggaacttccccagcagacgaatctgggccacagagttctgagctggaatgccccaggagccagccataaatctccccaaaatgagggtgcacaatctcattgctctggaggtgcgctgcttgcccctggagacgacttgtcattctgcgtcctccaggctctgcagagagccaggagccgggccagggagaggtggatgggagttggcaaagtcaccgtgaaggtaaacatttttatcatttaattaggagcctctcagaaaagcaagctctgtttcgtctagagctggtcaaaggaaatgagaagtgacattttcccacccccacgttccccttggcccgggaaactccaagctggaggcgcgggatgtgggcagcctcaggctgtgcacatccagggctgggcccaggggcagtggtggggcgtgcagcctttgctgtgctctggccgtgcccggcactctcgctccctcatttgctctcataaacgccgtctgcattatcgatcaccctctgggtccctccataatgcaggggcttcaaaccgcacccgctccttgagggtgctgcattcctgtactctctgcatctcccaagcatatgtgtgacagcaagatggctgcagatatgcaacttccaataatcaatcaactcttaaatgatcctcaataaacccttaagtaatgaccaggagcccctcaccagcatatctgtacccatttgttgctccatccatcccaatgcatgactgacaagtgttcacacacgtgtcacccgcaggctccactccagctttggaggatgcaggcaggacgtcactctggggctcctgtctcctggggagatgacagtgagggagggacactcatgaagaacctccctagccagttcctgactctgcgactgcccagactctgagggtactgaccaacagagctcactcagctacacagagatgaacctggaggcctagaagaggccggcctggcctgggtgcaaaggccccaggcagaagagcccagatgtcctcacttctttcccagtatggggcacccaaaacatgcagctccattttaatgagcagctgctgtcctttttcagctgctatgggcccactctgtccaggctgcagcctctgggcagcctgaatccagccaccaggtgaggcacatgcatggagaactgtaagaacattgagacttcgtgcctcactttacagggcagcaaatggaggccagagagggcaagatacatggccagggatgcacaggagcaggatgaggaaccgggccttgctcccaccctgcactcggaggcccaggtccacctactacagacaaggagtccgtgggccaggggtgggactcatctgtgcacggagggcccaggctgttttttctcaggagggacaaggctctagtcaacactgcatcagggagggacagatgtcatctattcagcagggggttttagcagcttccttagttcttgggcttcactgggtccttctgccaacaagcatggcccctggccccgtgtggacactctcccagggcagaggccatggctaaccagcctgagctgctccagatagcccagcagagatatccaagcagctggagccagccagccctcagcacatgtccatttattcttgcagcagctacttactgggcctgggcggagacaagatgatccattctggatgcatatatatgaagaatataaagcagggctggtgggatggggacatcatgcaaatgtagtggggtgctggagaagtctgtctgccaaggtagccaacaaggagaagccagatgtgctgacagctgtctagggcggagagcagcagagcaaaggccctgtggcaggaatggatttgctgtgttccaggcaggagaaaggccagcatgatggagccaagtgagccagcaaagtgaaaaggccagagaagcctgcagcctggggcatgggttccattcccagtgcaggaaactgggatttgaagcaagggttggcatggttgatactttcagaagagtcagtctgagaggggccctggatgccaggctgaggaggtgggacttccttctggaggagaaaggaggaccaaagaggcttttcagcagggagctggcaggtcactctccagctgtgggagccagccccttctccgggagctgtgcgggtgctgggcgccatcaagacagctccgctcctcccagccgtgagacttgggacagagtcaccctctcaaattctgttttgttctctgcaaaatagacataaaattttagacaataaccagctactccagccaaacaccatataaaaaatggtggcttgttcccactcacaccatcaaaggccgagtggggagcctggacttccaccctggccaggctgtaatgagttgcccaatctccctgtctccctgatgagtggtatcagagagggctcagtgaggggccaggaccttcatccccaccaggcagtaaccagccccttccaccccgtggtgtcagtggaggctgcacagggagcaggagccttcgggggaacctggactcctactcccaccttccacactgtgcctgccagagtggtgtcagaagccgccagctaaaccagaaggtttcaactcacattcagaatttcataacatactgcacaaataacacaatacaggagctcagcagcagcatggggggacaaaggaacacatccatgaactccaagagaaactatagaaattatttaatctgaacaacaaagctacaatagattgaaaatgaaaacaaaaagaacaatccctcaggaacctgtgagactgtaacaaaacatctaattcatgttattgagtctcagaaggagaggagaaagaggtgggccttaaaaaggactcaaagatacaatggttgaaactccctaaatctggcaaaagacacacacttacgaattcaagaagctgagttactcaaataggataaaccaaaaaaatccacaccacgacacatcacggttaaactcctgaaaaataaaaacaaagaaaaaatcttaaaagtagttgggagagaaaagaccccttcctacctatagggaaaaaaaataagaacgacgacagatttctcattagaaagcacagaggtcaaaagtggcacatttttcaagtgctgaaagaaaataactatcaactcagaattctatttccagtaaaatattcttcaggaacaaaggaaattaagatattctcaaatgaaagaaaagtaacagaatttgacaatagctgacctaccctagaatgattaaaggaagttctctaaacagaaagaaaatattaaaaataaggaatcttgaagcatcagaaaggaagagaaaaacagtaggagtaaaaaatattggtaaacatttccttctcatttttggttttctaaattatatttgaccgttttcacaaaaattatattgtctgatgtatttctgaatgcatgtcgagaaaatatttaagacaattgtattacaaatataggagggtaaagtagcttgaaggggcatgagttttctgtactctacttaaactggtaaaatattaacatcagtacactaaattatgtatatataatgtaatacatcaaatagccgttttaaaagctatacaaaaagacacactcaaaacacactataggctgggcatggtggctcatacctgtaatcccagccctttgggaggccgaggtgggcggatcacgaggtcaggagatcgagaccatcctggctaacatggtgaaaccctgtctctactaaaaatagaaaaaaaattagctgggcgtggtgtcgggcacctgtagtcccagctactcgggagactgaggcaggagaatagcgtgaacctgggaggcagagcttgcagtgagcggagatcgcaccactgcactccagcctgggtgacagagtgagaaaaataaaaaaaaaaacactatagacaaatcaagctggaattctaaaaaactttaaataacccataggaaagggaaaaaagctcagatatactaaaaatagtgagaacaaacagaaaaccaaaacaaaacataaaatggacaacttaagccctaacatgtcaataattatgtgaaaatgcaaatggtctaaatataccaattaaaagacagagatggacagaatacactaaaaatatgacccacctatatgctgtctataagaaactcacttcaaatataatgatatgtgtaggctggaagtaaaatgacgggaaaagataccttacacaaacatcaatcaaaaaaaagaaagcaggaataagtatattaataccagataaagtatattttagagcaaagaaaattgctggagacagaaagggtcattatataaggatgaatgggtcacccaccaagaagtcatagcaattctaaacatgtatgtacctaacaaaagagccaaaaaatatgtgaagcaaaatctgatcaaactaaaatgagaaatatataaatctacacttctttcaacaattcatagaactactattccaacatagaactactttcaataattcacagaactactaacagaaaattagtaaggatatagaactcagcaacaccatcaaagaacgttatctattcaacagatggagaaaactccatgcagcaaaagaagaatacatattcttttcttttcttttcttttcttttttttttttttttgagatagagacttgctgtgtcgctcaggctggagtgcagtggcatgatcttggctcactgcaagctctgcctcccgggttcatgccattctcctgcctcagcctccccagcagctgggactacaggcgcacaccgccacatctggctaatttttttgtatttttagtagagatggggtttcactgtgttagccaggatggtctccatctcctgacttcgtgatctgcccacttcggcctcccaaagtgctgggattacaggcgtgagccactgtgcctggccaaatacacattcttttcaaatgcccgtggaacatattccaaaatagactgtatgtaggccttaaaataaacctcaaaatttttaaaacaattgaaattttgtagagcatgttctctgactgtaatggaattcaactagaaaccaacagtggaaggataataagaaaatctctaaacaattgaaaacaaaacaacacatttctaaataatccatgactcataggaaatctcaagggatatataaacaacgttagactaaatgaaaagaaaaatgaaaatgcaatataccaaaattagtaggatacagctaaaatagtgctgagaagatggtggatagcactaaatgcctacatcacagaagagggaacatcttaagtcattaatctatttttacacctcaaaaatctagaaaagaagagcaaaataaacccaaagcaagcaggagggaataataaaaataaaggcagaatgaaatttatgaaattttaaacagagaaactatagataaaataaatgaaacaaaaaagcagattcttttaaaagatcaataaaattgataaacctttagcaagactgacaaagaaaaaagagaaaacacaaatcattaatatcgtgaatgaaacaggatatgactgcagaccctgaagactgaaggaaatcaagagaatactatgaacaactctgcacacataaatttgacaacttacataaaatggatgagtccctccaaaaccaactacaattcactgaatgtgaaataaatagcctatagccattagtaaaattgaattcataatttaaaacctcctcaaaaagaaatcttcaggtcgagatagtatcactggaaaattgtaccaaatgtttaaagaagaattaacaccaattctacacagtcttttccagaaaatagaacaggagcaaatgcttcccaatactattggtagtattaccctgacacaaaactaattctgtcttagtctgtaaccgactaagaaataaaaggaattcagactgggaaggaagtaatagctgcccctgtttgctaatgacatgattcatctgtaacagactaagagagtgttaaaaaagaaaaccataggccaatattcctcataaatatagatataaatattcctaacaaaatattggcaaataaaactcagcaatatataaaaataattatatgccatgatcaagtagggtttattccagggatgcaaaagcagttccaatatgtgaaaatcaataagtgtaatccacttgataaacaggctaaagaagaaaaatcacataatcatattaattgaggaagaaaatgtatttgacaaaattcagcacccttgagggatgggggtatggggaatgactggctgtttaacagtctgggcttccctctggggtggtaaaaatattctggagctagacagcggtgatagttgcacaacattgtaaatgtcctaaatgttactgaatgtacagtttatactgcttagaatggtaaattttaagttacgtgtattttatgaaaacaaaaaattaaattcaatacctattcataaagaaactcagaaaaataagaactgaggggaatgtcctcaactcaataaagaacattgacaaaaacctaacatttaacattatacctactggtgaaagactggataatttcctcaaagatcaggagaaaggcaagggtgcttctcttgccacttctgttcagcagcatcctagactttctagacagtgcaataaagcaagaaaaagaaataaaaggcattcaggctggggaggaagaaataaaacttcccctgtttgctaatgacatgattgtctatataggaaattctaagaaatttaccaaaaaaaaaaaaaaaagccaaaaaagcaaaaaaccaaaaccaaaacaaaaccatcactaataaataagttcagcaaagtcttgggatatgaggtaaacatacaaagaaaccggtgaatttctatacactagcatgaacacagggacactggaattaaaaattacagtaactaaaattgatgaaatacttaggtataattctaacaaaacatgttcaagacttatatgccaaaaactacaaaatgctgatgaaacaaatttagagaaattttttaaaaatctagataaatggagagacttactgtgttcatggattggaagtctcaacataggaagatatcaactctctctaagttggttttcaggtttaacacaatttctatcaaaatctcagcaagattttttgaagatatagacgtcattctaaaatttacatggaaatgcaaaggaactggaatagctaaaacaattttgaaaaaggataaagtgggaggaatcaatctatgtgattttaatatattatttagctacatttatcaagactgtgtagcattggtggagagttagttacatagattaatggaacagagtagagaacccagaaataaacccacagcaataggtccagctgattttagacaaaggtgcaaaaataattcaatggagcaaagatgatgctggagaaatcagacagttgtaggccaaaaccaaccaaacagaaacctgaaccttcacctaaatctcacatctgattttttaaaattaacttaaaaaggataatggatttaaacataaaatgtaaaactataaaacttttagcaaaaaataatagaaacttttcaggatttagaactaggcagtgttcttagatttgatgccagaagcaaaatccataaaaagaaaaattgataagttggattcatcagaatgaaaaccttttgctctgcaaaagatcctattaagaggatgaaaagacaatctacagactgggagaaaatatttgcaaaccacatatctgacaaagaaatagtctaaaatatgcaaagaattctcagaacaaaacaacaaaaaatccaattagcaaacaggcagacgtaaagcgatcttttaccaaagaaatggcaaataagcacataaaactgactgtcagcaatgtgtaaactaaaaccactacacccttatcagaatggctaaaataaaaataaaaaaatagtgacaccagcaaatgctggcaaggatacagagaaactggatcattcatgcattgctggtaagaatgtaaaatgataaaggcactccagaaaacagtttgtcagtttctttaaaaactaagtatgccactaccatatgacccagtaactgcattcctggcaatttatatcagagaaatgaagacttatgcttactcaaaaatctgtacataaaagttcacagcagcttttttagatagtagttgaaaactgggaacaccccagatgtcctttattgggtgaatggtttaaacacactatggtacatccataccatggaatactgctcagtggaaaaaaggaccaaactcttgttacacgcatcaacctgggtgagcctgcagagaatcatgctctgtgaaatcgccagtgccaaattgttacacactgtatgattccatttatataacattcttgaaatgacaacattacattaaaatggtgcaaaagtaactaaggtttaatagaaatgcagactaggttagcttaatggctcccaggggttaagggcaggatggggttaggggcagggaattcctctccttgagggagctgggagggaagtgggtgtggctataaaagagaaacgtgagggatcctggtggggaggggatgttctgtctctccacagtatcaatgtcagcatcctgattgtgacattgtagtatagtttgtgtgtgtgtgtgtgtgtgtgtgtgtgtgtgtgtgtggttttttttttttaaaatggactctcacacttgttgcccaggctggagtgcagtggcacgatctcggctcaccacaacctccgcctctcaggttcaagcgattctcctgcctcagcctcccgagtagctgggattacaggcgcgcgccaccatgctcagctaattttgtatttttagtagaaagagcgtttctccgtgttggtcaggctggtctcaaactccctacctcaggtgatccacccgccttgacctcccaaagtgctgggattacaggcatgagccaccatgcctggccaacactgtagtatagttttataagatgttacctctggaggaaattaggtaaaaagtacacaagatctctctgttttatttcgtagaaccgtatgtgaatttacaattattcaaaataaaaagtttaattaaataaaaaaatcactaaaaaaagttgcctagaagatttaacaaaattaaaccaatctgtgaatttaatgacataaagcatccaactttattgcttaattgttaaacttcatccaagcaatatgtagacattgcctaaaatatttcaacatattacaaggtttataaagaaaagtggcagtcccctgccctaatccccatccctagaagcattccatgtgagtctgttggctgttccttctcacgtttacttttatgattctaagtaaaatgcttaggctgccggttcttggtttttccattttagtgttaaccgaatgatggacttcttcccagggtaaataacagtcctgttcccttacacatcccctccaaccgcccccaccccacacacacatccttccctctccacttccttccaatggagttagatcatgatattgggtcaaattaatgttttatttttaacacttggctaagtaaatacccttcacagctgagtccgaccgttttctagccatccgtatcgtatattcatgcaataaatggttattggcacccaatgtttgccgggcactgttgcaggtgctggggacacagcactggaaaagcaaacagggtcctgtcctggagaagcttccatttttgaggattgggagaccaataagaaacaagttcaggcatattttttccggagataagcaccaaggaggagccccggacggggtgccatgagcaggggtgccctagggaggcctgaggagaagaccctgccaggggctgaggggagaagaggggacttgcgggctcctagaggaagagctcatccaagcaggacggcagaagcccaaagtcctgggagtgagctcgctgtcccgaggcccaggtgaaggggctgatatggttggggggagtccagctgagtcccttcttgccacccggggccccactgccacggggcgtcactcgcttctcttattaatgccgtcaccaccccttggcttcagctaagtttcagctttttccactctgaagccagcacctctcatctgttccgttctacccgcagcgttgccctcgtcctccccccaccctccgcctcatgggcgcaaacactcgggagcacacgtggagggtggaggcggcacagagacctccccagggaaatgaggctccagctggatttgaacacgcggggaggaggtgaggatgctgctttcccaacagctgggccgcctcgtccttgtcaccgctctggtttctcagcccaggctattttgggtcaggctgcgaggaccgctgcgtcagcgagtgggcgtgagtggcggcgcctacctcccccagttgggccgggcacagtgccaggccaggcccacccaggctgcgccaggggccgccagcctctgggcggcagggggacccctggaaccagggagagtggcctgagcaggaaatcaggtcccaggtaacacgggcttcagcgggctcaggctggggaggggacaggtgtctcggactgcgggcggaggaaccgcgcacatcagagggcagcgtctcagggcgggctgggatctggggagggattcgccaggaggggtcagtggcccaggccttccaggctgagtggcgctgggcagaggcacgaccaaaggcaggaggctctgggactatttagggaggagggaggctcaccgaggacacagaggccaggctgggaggtggccaccagccaggggcggggcagcaggtcagggagatcggatttccccagctcccactggcccgcgccttgcaagccggagatttcccctgctccgtggaaccctaacagctactctggggccttgcgccccatcccaggaggcccaccccctctcccggccagttctaccttctctgtctcagcaacccccacccttgcgactgaatgaagcactctgaacagagaccttttgaaaaaagtctaaatgtccccttcttaggtgagggaagcaaaagggaaaaatagaatcgacaccaatgacctattccagtctcccctcccgactgcagaaaccagcagagccacatgggcccacaggcggggcaggcccagctgcaggcaccaccctcctccctgtcctgagccgggcttgctctcagagcctgctgctgtccccaggctagggatgcgcctcccagcgggaacccctgtggagggaaagccccgcccagcccgaagctcagtcgcgaggaactgccgtctgttgagcactgccaggtactttttgactcatgggtcgttttgctctaacatgtgtatcccttaaaactcagaagagagtctggtcttgtttactcgcggttttttttgtttttgttgttgttgcttgtttgtttttcttttgaacaaggaggaagaatatctataggcaggaagtccccaactgtcctagtccccaggctgctattaaaaagtaccatagactggggacttaaacaacaaacacgtctaacagttctgaaagctggagggccaggcaaggcgctggcagatccactgtgcggtgaggcctctccttctggctcatccctggtgccttctcctgtgtcctcacgtggtgggcaaagcagctctctgaggtccttgtgtaggggcaccaatcccattcaccagggcaccgcccctgtggcctcatcacctcccaaatgtcccatgtcttaatgccatcaccatgtgggggagggcttcaacctgtggatttcagatacacactaggcccacagcacacactcaggctgaggcctgctctaccatttccgcagacccctctggacccgtcgcggtgctagtctgcagctctgttcagcacctgctgtgctcggccaggctgagggcagtgggtgggcgaatactcctgttccctcccctaaagctcaagcaccccttccagcaaggttctgctgtccctctgtcacaatcaagggaaaacgaggtactgagggtcccatggcacggccccgcagccaatcaccaggactaggcctgggagtcagcccccagctgtcatgcctggaaaccctgacctcacttactgccaggcccagggagggctgtcacttccctgggaagggccctccatgctggggacatactgagagtgccgactgattcaaaagactggaggagggatccaaggcaggaggcctcctgagggcctgaatggccacagactgtaggcacagggatggagagaggatgctgtgtgtgggcaggtcagcgaggaaggttggtgggacccatgggcctaagggtgaggaagagtcaaagatgacttgaggctttccaggggcacaaaatagaggatggtgaggccatcagggatggggcaagctgtagagggtgccgtgaggggctctggtggcggagacttgagctttctgagtctaatgaaagaaagagaaattggagagaagggccccaaggggtactgacctgggccgggctccagcatccagttcctataggggctatgaaggcctgagattagggtccgtctcaatttcagggggatttctctgctgtggccaaagcagcctgaagctaggccaggagttttgtctcctcactgccttttctggagtgccttgtagggattaatgcaggagggaaacccggttgatttcaggtgtgcaggggtcttgggggagaattctgggtgaggagcctacaccatttgtcccaggtgcagcttcgcccaacacgcacaggctcagcagggctggtcaggaacgatcttgaactgtcagcaccctcaatgagcctttgtatgaactggaaacagacggtgacactgaatcagggtacaccggggtccaggactgggggtggtccctggagggatcacagcccccctctcacagggcatgacccccatacctgcgtgctgtgcccctgaacctttgggtcccatggggttaccaagcaagcactggctcccagccttgtgacttcaacatggccaggagcactgtgcaggtggcctcagagaaaaggggcgggagggcccagacttttgctgggcaccccacctcccaggagagggcacctttctttttctgtgggaggatctgcagctgtggggcagacccccagccctcactagactgctcgggtttcctggaggctccgggccaagctagcctgagtgcggaaggtggcaggtgccccagatgcagtgtgctccatgctctcggtggctgtggccttcctgcgtgtgtccccatcggtggagtggcattggcacgctcctcacctgctcgcccacaccattccagccctgatgattaattgtataattagctagaagccacatgttgctcaggttgaatttggtctaaaaatattttcttatgaaaaacacagcagaacctaaaaatatctcctccacagttgcccagggaagcctcctgcttgggccacccccagccatccctagctgcaactcagtttcttggagagtctggaatgcagaggcagagggctggccaggcactgcttcccaccagggcaaggtgagctggggtatcaagactgtccctggcattgccagttcccacaggctcccaatgcctacagtaggtcagaggctgctggggctgcctgggaggctcctgtgtgcatacaggatgcatgccagcctgacttcacgggggctggggcagtgccacagaggaggcacagacctcgtggggtgaggtcctggaaagggcttcctcaccctggtgagccatcagggaaggcctgcaaaggaccagtgctgagctgggtgggaccctgcacaggcagaactccctgctgacctgtgcaggggagtaagggatgctggaagaagacactggccctgccctagagcccctaaactgagcattgctgcggctgaggcccgtgcacctggtcccatccctgcatagggcttggctgactggctacatgtcctgtggctggtggggacagacatgagcagggacatggagcacctgtatcttccaggctttagcacacagaagcaaccaccctgctctggcacacagttctccctgggtgggttagtcacaggggtcaagaacttaccatcttgcccttctcctcttcccttttggtgtccttaaatgggggccaccatctcctgcttcggaggctctgccttggtctcaggagaggaccccgtccacctggcctgtctgtgcaccttctatcccatctctggggtagatgatgaacccttagtgcctccactccctcctggcccagtggagccctggagcacatttccgggcccttctctctggtcccaggtgggtggctcaggcccagagagcttggcccctctggatggacacagaaaggtgggggcacagccaggatgggcactgccttctcctaagcaagcccaggtgcatggatggagcaagtgggggctccctgcagccccatccagccctgagtctcaggcccagggtggtgtggcagggatttggactgagtgtggcttgcagagggcacacctgcctggggacaaaatctgttaaccccaggtttaaacaataaaggcactaacaatctaacctccagagaatgaggaggtgggcggctccaggtgcctgttgcagttaaaccccatgaagcctggctcctgtctctacagtcccctcaccttccttcatgcttcaaagatggctgctgcagccccaagcatcacacgtatcacaaagggaagagatggcaccagcaaaatatcttcttcctcctccctcgtttttcagaaagccaaagccctcttgccaatagcttctccttgtcttgactgaactgtgcccacggtggtcacatggccactactaactgctagagtgtccagtgaagccagtgcctgacaagggagagcccagctgctataactggactggaacaaacagaattgcagcctctgaagctgagcacattgcaaccccaaactaaagcaggtgctgaaggcaagaagaggttgggagaatgttttccacaggagaaaacttcatccttgtgatctggggaggggcaaagtctgcgaggagaggctctgccttccccccaaccaggggcccacatttccatctctgataaataattggtaggtgtcgttccctggagcagatctgtaactcactgaggggaccttccaagctggttctgtgttaaatacacaaatcttaccacagcctttctgacaatcaggcatccaggccctgctagatccctgttgaaaggaaactcatcacatgtcaggcagcccattccttctggaggcttctctgacaggaaccacatccttattttgagctaaaatgggcttcccttggcttctagtcattaaccctagtcctactttcccacattttttttcagcaactttctgtgaatctattatttcaaaacacaaaattaaaaataagttaaggagagacacaaaaagtctaagaagtgcctgaattgtacttctagagatgaacattacaatgtctgagataaatagtacactcgatggcatgagcggcagattagacattacaaagtagcttagtggactagagacattgccataaagactacccaaaatgagccacacaaaaaattaggaatacaaatgaatgtaaagggcatcagcaaactagggagaaatccgcaagtagcctaatatatgttggaattgtagtgaccaaagaagtgtgggaacagaaaaaaaatatttgaagaaatagtggttgaagagtgtccaaactggatgaacactttaaactctagtgcaagcatagccaaccacaagcgcaagaacaagaagcaaggagaaaactaaccaaggtgcaatcatgatcaaattgcttaaaaccagtaacaaagaaaacatcatcaaagcagccgggaaaacaaggacacgtttcatcaagaggaccaaagagcatgaagataagagatttttcaccagaaacaatgcaggcaagaagtcagtggagagacatcattaaagcactgtctgtacaaaactgtcattggaggattgcatacccagcaaaaatgcctttcaaacatgaaggtgaagttgaggcttcttcagacatacagaagctgaaatcatcagcagatcttgtctgcaagaaatgttaaaagaagtccatcaggcaaagtgatactggatgaagatctgcacttacaaacaggaatgaaaatcactacaggtgagaactacacaggtacatttattatttaggtctctttaaaagaaaattgattctttcaaaaaataatatatagtggggtctgtgataggtaaaagtgaagcgtgacaccaatagcattgacaacaatagaataagggtggggagaagtatctcactataaaaatctcagactatgctaaagtcctgtgatgccaagatcgcttgaagggattgtgatcagttaaagactcacactataaagcttaaagcaaacactaaaataacaaacaaagagttatagctaacgagtcaaaaaaaaagagagctaaaatgtaatcacgaatacttgattaatgcaaaaggaagacagaaaaagaggaaaaagaacatgaaaaccagaggtgagcagccaccagaaggcagaagaggcaagcaatggatcctgccccagagcacccagggggactgtggccctgccagcaccccaatttcagccccatgatgctgattgcagacttctggcccccagaactatggcaagataaatttctgttgttttaagacaccaagtgtgtgatttttcttacactagccacagaaatgaatgcattgtatcaccctgggaggggcaggccaccaagtctcatcatcccctccaactctgtgtcataaagtccagacagtgctgctgagaagttagggctcctttcttctgcctcctgaatcatgagtggaggctctactccaggttcggggggctgagaacatggaggcgctgactactctcacccagctcactcacagggtataggttccacaccagtcaagtcaagtgaaaaagatcagaggcttccacccccacccagtgacaagaggagtgttgtagacatttttctcaggggtagaggctactcaggagaacacaaagctccaaactccaaaggtgtctcttgaagactgaggttatttgaaatagtgtgggtaaattcaagtctaagggctatctcaaaaacagtggagattttattagcaggcaaagagcaggctgatcactctgtgggcaacaagccaactgtaggccagtgagtttaccaggaagaaccaagaaaagagccctgctgggaccagaaaagaatccaaatattatctctgtctaaaattaattttatcagactagaaaaatgcatgccccaggacattatcaaaatggtttatggttttgtttctgaggcacttgtaggtcctgaagataattgtacatattctcttctaaaaactttatatttcttttacatgtagatatttcatccttagaattgatttttgtaaatggtatgaagtagggatatagttttagttttttccacatggatttgcagtctcctaaggaccgttgattgaaaaatcagcctgttcctcactgatcacgcacacgtgaagtatacagattgtggggtttgtttctgggctctgaattctattccttggcttacatgtgtagttagttatttttgtctgcaagcatttcattttaccttggagtattatttgtgggttcctccagggacgatttgtcttccatctttccagtacctgggacaccaccactctgtctcgttgaaaattgaactgccagcttgaggttttcagaccacctaaatcttatgaattcaggctgaaaaatctacatgaagaccactggcttctgttgataaattctcagcagggattttcacctctttcctctcggcactgaggttcaaaatggctggttttctttgttatacccttgagaaaggcagatttatttccagttgaccctcactttgagcagacagctgattggggtctcagctctgtggggatttcccacagaaatctgggcctgccatgggctttgacttctgccctctgcccaccaggaagtcacgaaactggaagttcaacttcccgttgctggcaaattccctcaggaatttggcttgccttttgggtgtctgtattctacaaatgttttgacttgagaagttcttgcttttggctaaatctttaatacgtttttaaaagactatttataaaattttgtccaggttttcagtgcaagagctgatccaggtacctagctcaccatgttatccaagtgtccagtacaacccaatttttaagtttttaaattgtataattttaaaattatgaagtgtgttttgtctttaggattttgaaagatctgagagttctgtcttatcctgagaggtaactaatgtcccttccttccaactcttgcccctgttacctgagtccacctgtagcaggtactttaacatacataacgtgtgacctgctggtgctggagtggggttcacttcacttccacagtggcctctgcaggggcagggagtcctggagccctccgtgtcccagaccccagttctgactttatttgagtcaagagcctctttaagaatctgatgaggccggctgcagtggctcacacctataactccagcactttgggaggctgaggtgggaggatcacttgagcctaggagtttgagaccagcctgggcaacatagggagaccctgtctctacaaaaacttttttttaaaattagccaggtatggtggcatgggcctatgatcccagctattcaggatgctgaggtaggaggatcacttgagcccaggaggttgaggctgcagtgagccatgactgcaccactgcattccagcctaggctacagagtgagattctgtctccaaaacaaaacaaaaaaaattctgatgaaagctagacaagggcgtacagaacacacacagcagacacagtttctgttggatacaccttcagggggcctgtggatcccttgcagtgggatcccctaattctaagaccccccaccccacgcctctctatagcacttccctgtgtttgctgctggcaggacaggaggcagcaggggctagcacaggccagcctgctcagctgtgggtgttctgcagcgaacctgctgtgcctgtgtcacataccaagggcatgactaagggctactgatgcagagtcagaagtggcccagccctggcccctacctcctcccaggctcctctgagcctcagcagagactgtggccaagtagtgaagtctctggcggacatctggacctgcaagccatccagagcattgtccttggcagtggcgagatggtcaggtcagcacctgggtccttcccagcttaggcacactttttgccaggataggagcttctcaggccagggcctctcttgccagtgcaggcagtcatgcctggcatcaagtccagcaggcgcggaggggactgcaggccacagctgttcaagtgggggcctcctttctgccctgcgaggccctctcagccttgatgagatcacttgggggccttctatctctgggactccagaaatagagacagggaactgggagtgaaagcagccacatgtgcttgggcaccatgagtgctcacaggtgccagaggagcagacgggaccaggtcagggactgcagcccaggaccagccagtggggcttctgcagtgcctcatcctgttcctgccatgcctcactgccaggaaaacagccacccttgaccacctgcccaccggcctctcccaaagaagacactccgagaagcaactgctagaattttctcaggactaatagcagttgctaactgtctccaaagcacactcagctgtccttggggctcagccagccccacacataggagggacaaggcccacagcgcacaggctcagctccacagcacagggcttctgtcctgaggccccgtaagcctccttccagcatgcctttctgttcatggagtattcactttgtgattgtgtaatcaaaaatcgtcttgacaatacagcattctcccatactagacttactcagagatggtctgtgctctgaggatgatgctagcatggctgctgcctgggcacctcagagcagtcctgacacagcccccatggagccccacctcgaggagaatgggatagcctggggatcctgggcccggagtgggccccacgtgagtccagcttgctccagctgactctctgtgggcctccattttcttgtctggaatggaaggaaatgatccctccagctcataataatgatcatgtttatgtcagatcatcgttcctaggatttccccaaacctccacgtgcctgggagaggagtgagttctccagctccctgggaccctcaggggttacacacaccaccatcggccctcccataaaggctgcaccttggctcggcctccactgtgggcctggctgcaggctctcaccccagctggtaggagctggggtgaaggaggccagttcaggcgagtcctctgcaccatcctctgctggcccgatttcccgatcagcactggatcagcctgagtgcctgaatccagagctcactctccacttgggtgggagcatggctgcttcctgtcagccccagcggtgtgactgggaccagagagtctcctgcagcctgaagaattgtcccagcctgcccacccccggcctcctgtgctccaggcaggcgtggctctccgtgtggcagatctcactctttgtcagggcctctgtgtccttcctcctgggacaggcttggcctcagagggtgggagggaagggagggccactgcagccgcagctgctgcatcaggaggggccaggagtccccaaggtcgagtccagagcgcagcagggagtcccagtgctgacgctctgcacatgtggcgtccttgtcttgccccagctgcaggctccatgtccaaaagcacatggagggagagcagaggtttcctggggacagcagctgaggccaggggctggtgtgctggctcacaggctctgaggctggggatcactgacattgtgctgctgcggcctcctgcccagggagcctgctggcaaggggcccactgcgacccgggctgcatccctggccagccctctctcactggaggcctggactcacccctgccaggaggggagctctgtgctccctctctgctctgtgctccctctctgctctgtgctcccttcctgcctgtctggcagcacagtgaccacctccccaaaacccatcccggcacggaagtggggcctcagagcaagcagaggaagaaccaggggcccttggtgatacagcctggagggggccttggctggcacttgccattggtgtcgggcagacaccggcccctccacccaccagaagatctcaggcacacctgcccaccctgaaagcaagcaggcagggagtggcccccagagctgaccagagggagagaagacaggaactgtagagacaagaggagtccaccgcccagcctggggcagcaccttggaagctggggttgggctatccaactagaagggacagaagccagctgtgcggttggttggtggtgggctggaaaggggcagagggactcaggacgtgccttctgatgggatcatagggtctccataatgcattggccacaggtggatgaggaagaagttgcctcagggttgtcgtggaactcccaggagggctacgccacccccatgggtgtctccaagccccacgccacctggtttgcagaccatgggcccctagtcatgtcgcctatctgggcctttttttaaaaaaaaaaatttattttgagagaattgtagaatgagcatacaattcatgcatgcacttataagaaacgatacagagaggtctgaagtaccctttacccaatttccttcagtgataacatcttgcaaaactacagtacggtatcacagccaggatactgacatccgtagagtcaagttacagagtattcccttaccaccaggggccatccgcagccacacccacttccctccctccctccccagcccctccataacccctggcagccactcaccacttctccatttctacagttttgtcatttcaagattgttatataaatggaatcgttacattatgtaacctcccggcattggctttttttttcactcggcccagatccctgtagatccatccaagttgtcccatgtaccagcagttgattgctttctaatgttgagtaggattccatggagtggatgcactatggcttgaccattcacccattgaaggctctttgcagagctctcggttttgggctactgtgaacaaagctactatgagcttttgtgtacaggtttttgtatgactacaagtcttcatttctctgagataaatgcctgggagtgcaattgctgggtcacatgtcagttgcatgtttagttttataagaaactaagaaactgttttctggagtggctttaacattttacattcccaccagcatcatgtataggtgatgcagtttctccacatccttaccagcatgtggggttctcactgttttttattttagctatgttgatgtgtatataatggtatctccatgcaattttaacttgtatttccctaatgagtaatgatgacaaacgtgttttcatgggtttatttgccatctgggtatgctcttatatggaataactcttcatatcttttgccagtttcctaattcgcttgtttgtttactactgcattttgagagttgtttattctagatgttaaaagccttcatcggatacatagtttgcaaatattttctcccagtctgtagcttgtcttttcattcccttaacaggctctttcacagaacaaaagcttctaattttaagaaagtccaattgttttttacgtcaattctaacaacgtggctagttctagatcccgaaaattttctgctattaagaaaaaaaagctttatagctttacatttacacctaatccattttgagttagtttttgtataaagtgtgaattcattatttttgctgtgatgtccagttgttcccgcatcatttattggaaaagctgtccctcctctgatgaatggcttcatacttttgcggaatattaggtgggcatatttgtgtgagtctatttctggggtccgttgatctatgtgtgtctgtccatctgccaataccctactgtcttgattagtaagctttaatttcaaatagtgattccttccacttattcttccttctcaagatgggttttgctgttctaggtcctgtgtgtttccacataaattttatggaaaaataagcttgtctatatccacaaaaatacttgctaaaattttgacagtaactacattaaacctgtagaattttggaaaaattgacatccttatatgttgagtactgtacatgtttttttaagtttataatgaagtatttcattgtttttgaaatgactgtaaatgatattatatttttaatttgttttcacaccttcttttttaatgtatagaaatggattgatttttgtgtgttgatcttacatactgcaacttgctacactcacttattagttcttttgcagattccttgggattttctacagagactgtcatgtcatctgcaaatacagacagttaatttctttcattccaatctgcatgtcttttatttctttttcttgacatattgtagttggtagagcttgcagtagtctactgcataagagaggtgagaatggacacttttccttgtaccaaatcgtagaaggaaaatattcagtcttttaccattaagtatgttagctataggtttttacagatgctctttatgaagttaagaaaattctcctttgctccaagtttgctgagagtttttatcatgactaggtgttggattttgtcaaatgcttttcctgcgtcaactgatagaatcacatgacttttcctctgtagcctgttggtaggtgtattacattggttggtcttgtaattctgaaccaaccctgcatacctgggataaatcccaactgctcatggtgtataattccttttaaatgttgctgaatttgatttgctgatattttgtcaacaatccttgtgctgaagttcatgagaaatgttggtctgtacttttattatcacatgttgtctttgtctggttttggtatcgggcctagcctaataaaagtgttctttcctcttctattttttaagacggattttgtaaaataggtgttaattcttcataaatgtgtggtagaattctccaacgaagccatctgggcctgaagatttcttttaaatttcacattcagtgtgtttaattgttataagactattcaagttgcatgtttcatattggttgagttttggccatttgtggtttttgaggaattggttcatttcttccacactgttgaatttatgagggtaaaactgtagcgttcctttgttgtctttaaaatggctgaaagatctgtaatatctctgttttattcctgatattggtgatttgagtcttctcttgttttatctttgtgaatcttgccagaggtttattttttgaagaactagatttttgtttccttgtttttctctattgttttcctgttgtcagtttcatcgactgctgctctttattatttcctttgctctgccttgctctgggtttattttgcttttctttctcgtgtttcttgggttagtaatttcgatgactgatctgagacttttcctcttttctaatgtaagctttcagtgctgtacatttctgtttcaggctttttcagggttttttcatttgaaagtggaaggtttgcatcggcacgcggaatagagaagacaggcgtgcttgagaatgggctctgccgcctctcagcctgctccctgggttggttatttcaactcccaggggttcctaatccagaacccggctgccgtgcacaaggctatgggtttctgggaagactaaggcccctgctcagagccgaccctcagcaaacagcctttcctctcgctcctttctttcctgctccagcagtttgattctgtgattaactttaaaataacatttattttacacgattacaaaataaatatattttcatggaagaaaatttggaaaacacaaaaagctatcgagaaaataatctatctgcaaaccttgccactccaccccgcctggacctctgctcactttggcaagcaccctcctgacttctttgacgtgaatttgtttttccataagttattggggtacgggtggtattttgttacatgagtaagttctttagtggtgattagtgaaattttggtgcacccatcaccagagcagtatacattgcaccgtatttgcaatcttttatccctcgtcccctcccactcttcctctcaagtccccaaagtccattgtatccttcttatgcctttgcattctcatagcttagctctcacatatcagtgagaacatacgatgtttggttttccattcctgagttacttcacttagaataatagtctccaatctcattcaggtcactgcaaatgctgttaattcattcctttgtatggctgagtagtattccatcatatatatataatcatatatatggaatactactcagtagtgtgcatatatatatatatatatagtattccatatagtagtattctatatatatatgtatatatatatatatatatatatatatatatatacacatatatatatatggaatactactcaatcatacaaaggaatgaattaacagcatttgcagtgacctggatgagattggagactattattctaagtgaagtaactcaggaatggaaaaccaaacatcgtatgttctcactgatgtgtgggagctaagctatgagaatgcaaaggcataagaatgatacaaatatatatatatttcatatatatttatttatatgtatctatatatgaaatatatttatatatagatatataaatatctatatacaaataaatatttatgtatatataaataaatatatttatatatgtatatataaataaatatatttatatatttatttatatatctctatataaatatatatgaaatatgtataaatatttatatatacatgaaatatatataaatatttatatataaatatacagttatatattatatatctatatataaaatatatagatatatgtaatatatattttatatatagatatataatatatgtatcagagtttccttatgcactcattgattgatgggcatttgggttggttccacgattttgatattgtgaactgtgctgctataaacgtgtgtgaaagtatcttttttgaataatgacttattttcctctggtagatacccaatagtgggattgctggatcaaatggtagctctacttttagttctttaagaaatttccacagtgttttccatagtggctgtactaatttacattcccaccagcagtgtaggagcattccctcatcaccacatccacgccaacatctactgttttttgattttttggttatggccattcttgcaggagtaaggtggtgtcacattgtggttttggtttgcatttccctgatcactagtgatgttgagcattttttcgtatgtttgttggccatttgtgtatcttcttttgagaactgtctattcatgtccttagcccactttttgatggcattgtttgtttatttcttactgatttgtttgagttcgctgtagattctggatattagtcctctgtcagatgtatagattgtgaaggttttctcctactctgtgcattgtctgtttctctgctgactgttccttttgccatgcaaaagctctttaggttaattaagtcccagctatttatctttgtttttattgcatttgcttttgggttctttgtcatgaaatccttgcctaagccagtgtccagaagggtttttccaatattatcttctagaattttcatagtttcaggtcttaggtttaagtcctaaatttttgtttttatgaagtgcatgtgtatttgaagtgttcaaacacttaacagtatctcacttcacttagcagtatctcaatcatatctttgggttatcaaatatttttctaaaatatgattttaacatatgtggatatgtcataattccacagctgatatatatttaagctttaatttttgtcattatgagttgaattgtgtgaacaaattcatacatctttgggcatgtctctgatttttttccttaagacagattcttaggaggggaatttttgtgtcaaagactatgatcatttttaagattactgtctagaaaatgtgtccccaaatctactccacctggaagtatggccaaccttcctctatgtggagtattcaattattttttaaatattgtatttgcctttattgtgaatgaaatattatattttattgttttaacttgcattccatgctagtaaagcaagtgtaactctcaatgtccaatcacagatgtaaagaacaatcttgtttctctctttctggacaattccaagcccctatcccttccttggaccttttctgtggtcttttttctgggatcttttatggagactttctaggctcagtgaccactggccctggctactgctgagaccctgtggctctggtctgcagaccagaaactataaaaatgggcccttcaggtttgcagtctttgatgttcccattccctccttggccataaggccctcccacccctaactgcagcacccaccgcctggagtcacaggtgcagccccagcccctggcagccctcccgggctctgcaaggccccagccccatctgaatctcagatgttctccctggccaccccaggacaccagtatcctccattcagggcactgggcttttaagggagggcctgcctctgggctcttctcacttccagagagggcaaaacgaaaacaacatacattcagcaactcagaaatcaccttgctgcacagccagtctcctgggttcacaggtttttcctcctgtgtgtctccctgttctcctgctctttcgtgattgataagagctctttgtacaggaaggacagtggtcctccagttgtagtgtgtgtggcagcggttccccgagggaggcgttatttgctcttgaactttgcctgcgagctgtgcctgtgcattgctttgctttttaattttaaagcgagttgaagcctcctgtgtttgtttgctttcactgtgctttcctgattggaaagtcttttccacccccccattcagcatcttatggtttctttgctaacactggaactcaattgctctggaaggcacttgggggttaggggtgggggatcccattttctcactaggtagggtgtgcccccggcacccctaggaaagtccctccagccctctgcatttgctggattgcacaggaggcccagggtctcctgagggggaggagatgaggaggatgcggagaggtaccaaggggtcccccaccttgcaccctgcgaagtccccctttctccctgtggaagggaagataagcctcacctaggcgctgaccatgggtgaccccttactctgcaggtgggtgagacccttggagaggcctcctgctagtgctcagcagggttcccagacaaaaggaattgtcaccctttgggtggtggctccatggcactgcaggaccctggagagcccctcggctccggcccaggggcagagagctccatccagcctctgtttcccacctgggccttcacctcaactgtgctcgaggcaggcagggtgggggttgggtgggaaggaggcagagagagactctggagctgggtgcctgtgaagagggaggccatccttctgaagatgtcatcggggtctgaaggcacattggaaggtgcactcagtcaccgaaattagacgagggacaattgcgcagacaaggagccttcacccctgttagtcggggacacagctcggcccacgccccacctccacatctcctccccatcctgctgtggcagagcctgccctccagccctctgcagccccgaccccagtccggccctcagctcccagccccgcagctgcagaggcttcctggggaggggcagctcctggtccaccccatagcagaggtcaggcagctatcttgcgtctggcatctgcataggactaagagatccatcaagtccaattaggggaacagctccttcctgctctgcttagctgactaattcaatagcagccacccaggcctgggccggcagaggctctcccaaatccaatgaaggccttgctctgcagcccggctgccagcatcacccaggcattttgctcactcagcacagacccaagtcaggccccagccatacccaccaccaggagctcccagagccgtgctgctggcaccaggcctcccccagcaagctcccttcctcagggcttctgccctagagggaaggaaacttgtggccattgaggggtaggggaagtgccacagcccgtccaggcctgtcatcccaaaggaaggcccacagctgctttccaggtcttgtagaagctcgttccttccccggggtgctcttgctctgaacaatgccccagggcaggtggaggggcagatggaaatcagccacggggcttttgcaggcaagagtgcaggagggactctgcatgcctgggctcaggcctcagcagagcctgttgagggaagggatggaaaagagtagctatatggcctccctcatggggtcccagcccacagctgtgtcccaaacatcctgtgtgtccctcaacacccagcctggatgggttccttaactgagctcaagtcttagacccgtagaggcctggcacctccaggttcactcaaagggattacagagaccaagcccaaacctacccatccaatgctgggatgtgaggccctgccaaggggcttaagtccagctgcgacaggaggctcagagacatgagccaattatgacttattaaggacaaggcgttgtaattttttttaactgcttgatacacgtgatcaaggcttacttcagcctctatctcctgggctcaagtgatcctcccacatcagtctccccagtagctgggaccacaggcgtgcaccaccacgcctggctaatttttttattttttgtagagacagggtctcactatgttgctgaagctagtctcgaactcctggcctcaaacaatccttctgtctcagcctcacaaggtgctgggattatagacatgagacaccaggcctggccaatacccattttatagatcatttgagtgagggtgttttccctgtaactcactcagtcccactgaatttccgaggcacattctggaaagaaggcatggcatcactggtaggggtctgccccagtgcactaggacaccactgggccacggtctctctgctcttagctcactcactccatcactctcgaaatgatgtaatatgtacagacatctcaggataaataggtccatacctttggcaccttctgttaaagcagtaagttgtgttgtttatttatttttgctttgcctgcgagttgttttattgctgttgttgattaggtttttattaaaagtaatacctgcacaccatacatctcgaacagtattaaattatatgaaatgtgcacaatgaaatgtaaaagcctactcccaatatttcctctctcccagataactgctcttgaccgtttcttgtgcatactctcagaaaaacacttatgcaaattcagcatgtgcgcaaacagcgtgatgctgcccatgcttctgaggcatgctgtgtctgtgacgcctttttttaggtgtaatggaatggatgcccacgtgtggatgtgtgtgtgggccatggctgaccagtgccctgctgttggcccctgcagacaacgctccaggaaattttacttgttcaaattttacttggaaaattctgcaagtgtgttcttaggataaatttctggtagtacaacccaaaacaatgagctaaaaacaacctgggccaaaacatctgtgcaaggaaatttttaaacggatcttgtcaaattgttttcaaaaagatttccacatctttcaacagggtatgatgttatcaccactttccaatgaaaaaagaatgtcattctattttgtgtttatttagttatgagtgaagtcaagtactcttttttacatttttgtccatttctccattagggtaccttttcttattggtgcctgagagcacttagtccgtttaggaaatagggcccttagctgtcatatgtgctgcaaatatttccccccaatttatttgtttgtttattttatcataccaaagtcttacagtgtgtaaacaaacgtattgatcattttaaaattcatttggtttgggttgctcagaaaggtctttatttttttaaaaaatcatgtttacttccagtaattttatggcttaatactttagtctggaattgatttggcatcaaataactttatcaaaagtagccttattttttccttgtggggggtctcgagtcacgtcattatttatcgaatggtccctcattgttcccattagtctaaggccaccccattgcctgtgaaatttccattgtgacatctatatttggactctgccttgtaaatttcttatgcaatatcaaaccgtcttaactgtggttgtataacacagtccatttcactatcgctgtgccagccttttaacgtcctcctgtagcagttctgagttgtcttcatgtagattccacacacttgttaagattacttctatatatttttattttatgtattgcttttgtgaatgtaatcttttattccattacctctttatttagtcatggtttatgcatgggaaagccctcgatctttgcatgttatttttgttagtagcaactctgcagaatgctcttattttcagccaagtctttgggtttcattggccagccctgtacctgtgtgtgactccatcttcccttcctctcttctcctgtgtccctgtctccaagacatcagcagctcacgatcagactcctgccatgctccctggctgtgggggctgcagcctttgggctgatgtccgcttgtacgcacctccctcttctctgtctcatcagggttaatggctactgaactgccaaacacctttgcaacgtttgttaaactttacgttttttattcttcaggggttaattttagtcatttacatagctctagaaaatcatcatttttacctaagtatccaaattttctgtccagcagtttgcaaagcaggccctgatgcatcttttccatttctttgcctctgtggttctttctccttactcatttctgcttttctctcactccccactgccactccgcttttcttactccatggtaggagtgcccatctctttgttggaaggcaacagtcactctcctgtctggctctgtcccccaggagggctgctgggggtctgtgcctgtctggtgttgtcagactccagcgcggtgccattcaggcttgggagcccagtggtttctctgctgatgaaggggcccgtggccgtggtgggtgctggctcattcttcatccccaggagcagggatgctagaatggcctcagtttggggaaggagctgggggtactcctggcaggggatgtgctgaggaacatcttaccgtccacttggatcctgggggacaagagttgggtggcagttggagacccctgggcccatgagggtggggatgaccagcatactctggcaggcagtgtgtgggtcctctgaagcagctcccccaaaaacctagtggcatatgcccctgttacagccctgaggataaggtggggaggctggctggggacatggaagttggtgctgactaacgagaggccagtccctggccctgtggcctgaactctaggtgtctgtggggttctgttggcacagacacaccacacgtctatgttcatggagactttgtcactggcaaaggcaggggcttctcagcagggagggggtagagccaggcagggcagcagtgggagggctaaggtccccctgggtccctggggaaggggctggaggcagcagcagggagactgggctgttcagagggacctggaaagatattgggtccagcagagcgactttggagtccacaagtgatgtggagttggggaggccctcaccccaccccaggcctggacccctgagctgtccaaagcagctcctggtaggctgcggctgaaatggagggcctgaggtgagagagaggagcagaggggctcaagcttggggccagtccactggggctccacgaatgacctgggagaggctcagagctcgtgaaggggccagggtgtcaggattgttcacccagaggcacccctgttctcatccaggttacagaagagcctcaggtccagtgggagaggggagaatgccctgcacacagtgccagcccctccttgctgagctctgcatgcctgggtgaggggctgatgctgcacccccgctggggctgcctgccagggctctggaccctcccacaggaggccaggcctgtgcccagtggcaggggagggtgtcctctccagccagggctccagcctccctccaggctgctctagctggccccaggcaatttgaaaagccccctgggatttcctgacagtacaggcccagagctgaactgagcacagccctcagccaccaaatgggccatcagtcacccaaccctgagagcccaccccctccagcctcccctgcaggcagcatcaccctgggagccctgcactccagagccacttcctccctgaggccctgcacctctgacagccaccacaccatgcctgagccgactcagcctggatgaggtgcagtcttctccaggcctcccaggccccacgctgcagccacacaacctaccgctccatcacagttaccctaggagggggttggaaacaccagggctggcatgtgacagactggctagcccctaggtccttttgaggtccagagaagagactacagggtcaggagcaggagagactcacgcctagggtgagggggtgctctgcatcattttcctggtgcagaaacaggttggagcattgctgaggaccctgagcaggatttgagccagggtgcacccgcagggcaggacggaagatgccacatggctcacccacccctggggccacatgcagagttactgtcaagccacgtcagcacccgcagggcccagtgtgagcacagcagcgactccaagtgggtgggagctggcaagccacctgctggccagggatgcctgttcgcctgttagaggtagcgattctcgttcagagtggaccacagcctgatgacccctgctttcaagaaggaccatcccatcttaaacaacagctccatgaatacaaccctccctgggagtgcagtgaggccatttttaccaggctgcctgtaaggatggggtggaggattggatctatggattaacattccctttggggacgcatcgcgggcagatgagaaattcccgacagcttgatggtcagggtctccattacccatatatcaaggagaggaagacggattccccacgccgactgcctgcccagcctccctgccgacagccaccgctgaagggcggttgatggaggttgtgactgtccctgtgaccaccctcctgaggccctaaagcacaggagaactccaggcagaaacagatgcggggtaatgtagcccccctcagccccagctcctctgggaggggctgttttgtaaatcactgccagccccgctcctcctggcaggtaagattgaggcagcagggatgtgccccgagaaacagagctggtggagaggtttgagggggcatgtgggtgactgcctgtccccaccaaggggcaggggctgcctttctatctgggtcggcagacagccaggctgcccccagggaaggcaggggtggcgcctggggtggatgctggcattggaatgcccaggtaaaaccctgactccatccatgttatttatcctctctgagtcttcactctgtcgtccatgagacaggggtgattgtatgtgaggaggaaacccatgtgcctgagaacagcgtggtgaggagcttgcacatgtggcacagagacggtgcgcttgtgattaggtggcctgagggaaggagtactgtggctgtgggtgttgggctctgctcctcagaagaccccagagggcaggtggctgagcagatctccagagctggagtgcccaagtggattctggggtcaggaaaggaagtgatatgattgggggccacagtgggacacttgagccatgtgtccaaagagcctctgcactcacagagccctttatcttgtggggcagaacactcccccaccatgaggactcttctgcacatttcagagggcaggactgcaaaacccaggttccacctccctctcccattttctggtacagcatatggtaggtgctcattcatgctgagtgaatagagagctgggcaaatgctcactggcactgagcttcactgaacttctcacatgctactgtgtattgaatcttgtacatcttgcagagcttcgtggttgaccaagcacttgtcatccttcactctccttgcttgtcccgtatagctgaggaatgctgggcacaggcaggcaggattgctgtcgccgttgtacagagcacaggctgcccaactgcaagggccgtagagagcatccaggtgccatgagcaccagaggggagtacctggcctcatggtcagagaccaggtctagtagaggaagggagacagggatgctctcattctcagagcagaatcctttcttcacttaacctattttgttagcattaaaaaaagagaaataggcttgggccttatttatgctcctggtttttttaaattgttttattaatatctactctttagtacttctttacctgctttttgcttttcaatttaaatacacttaagtctttcttgttgtttaattaatgtatacattgaaaggtgatatgttttcctgtaaatactgctttagctacattccacaggttttgctgtaatttcctatcctacaatgctgaatgatttgaaatttccatcttgatttcagtcatttaggaggatatttgtaaatttccaagcatatttttatatacgtatttcttaattgcttattttcaatttattacacagtcagagagtgtgtactatatgatatcattttttaaaatttcgtgggacttcctttccttttacttcctgattttcctaattttttaatctcattgaaccatccattactttttttttttttttttttttttctgagatggcatttcgctctggtcgcccaggctggagtgcaatgggtgcgatcttggctcactgcaacctctgtctcctgggttcaagcaattctcctgcctcagcctcccgagtagctgggattacaggcgtgtgccaccactcccagctaattttgtatttttagtagagacggggtttcaccatgtggtcaggctggtctcgacttcaagtgatcaacctgcctcagcctcccaaagtgctgggattacaggcgtgagctactacgcccagccctgagctatccatttctgataagaaaatgttttaaagcttacactgaggtggcaaatttgtcagtttctctttgcagcaagattatgttattaagtgcgcacaagttcatggttagtgagtcctactggtaaatgcattgtagtgtccctcttcatcctcatgagtgcttcctgccttcattctgtgtccgttgttagtaatcccatgtcagcttttctaatgttttggtctcgtattttctgggtatgtcttttatccctttgccttttgctataatttggtttaggtgcttctgtaatgtcaatttcattcatgaggaatcaaattctgctctgttacagggaccctagctgatccccaacccttaggaacagagagcctagaagtatctatgctcatgtccatgtaatatacacacgtgcccacacacacctcacacagttcttacactcacacatatacacactcacatatacacttacacgctcacacatgtacacatgacatacattcatactcacacatacacacccacaaacacatatatactcacacatatacacttataccacaacccacaaaaacacatatacacatgacatgcactcacacacatacatatttatgcacacaacatacattcatacacttgcacactcatgtacacatacacacttatacactcatgcatatacacatacaatatacacacatatgaacacatatacgcatgacatacatcacacacatgcacacttatacatacaacatacattcacacatatacactcacaaatacacacttatacacacaacacactcaactacatatacactcacatccatgtattcacacatactcaaagcaattttaatttgtaggaaatctcagtttaaaaatagctgcagttcctacctgggcatcaggtaacctggaagagaggaaggagaggactgtaattagcgaaattcatgattcgaaaagaagccttggcaaggactggattcgagtccttttgtgaccctggctgggcgagactcatctcttgggagcctttgttttcctccctaaatggggatcacctgagggcacctcctgctgtgaagctaccagacaccctgaggggaagggatccctgggctcctgtcaggaggatgtgaactgcctgggtgggggcagcattccccctacttctcccctcctgggtaagaggctgggtctctggggcaagtggagtcctggcttatcagtcagccacaccatgaacacccagttctgcctccaggtgtcaaataggcaatttaattaaacagaaattcagcagccagcaacatgacgtcatagttcctggaaacagaactgtagccacaattctagtagctcattctgtccttcaagagtttaaaattttttaatgccggagctccatttgatcaccttcacgcggccctggtgggtcaggcccacctgctcgctggcagcccctccttgcctctctgtggtcccaccagtaattaagccttttaagagctgggggagcttcaatatcggtaattcaatctccccctgtttactgatctctgccattagccgagttgaaagcaaaatgttttaattaaaaagattggcaataagttggtgtaatgccataatttgcacagggccccttctagaggatgacttcgccctgcctcagttgctatgacaactaatggacaagattgttccagtgtgagaagcagcatgaggaggggacaggagtgggaagaggggcctctgcaggaggacagagctgtgaggtggaaagaccaggcctctccgtgagctccagggaggtcttgcctctttgttgccatccctgtggctggaagagtcgtgtctctaagtgcctgggccaaggttgtcatggccagtgccatctgggctcaatggtccagtacagagcagagggcgagactcagcagccattcaccctggagtgtactggggccccgcctctgaacagggcagctgtgcggcgggccaaggcagaccccgggtaaatgtcaaataaatgcccctcacctcccctcccacacaggggccaggtaaagggacgtccgcatgtcacctgcctttgtgtgctgactgtctgttgggacacccaggggccaaggtgatgtcctggagaggagctggctcgggaggcactcaggctgcagtctccttccaggactcccaggctagacagagcagaagatggcaactgctctgggtgccccacagctgatattcactcacttctctgaccatggggccagatcctcctgaagaggtaagccctttgtgggagcggataaggcgaggccttgtggaaagggaccaggacattccgagtcttgatttcctcatctgtgaaacgggaatgaaagcatccttctctcagagtcactctgaggactgacagaaaccgcatggtgggtccaacatcctctgcggctatgctagtggtgtgggtgtgccttgaggagccatggggggcaggggccctcgccagtcagctgctgtctgcacccagggccacagggcaagggtgggctctgaaagagcaggacaaacagccagaggacttggctccccgctcctggaggagggcaggtctgaccagccaggagcaggttggggtgtggggtgaagcagaaaaccaaactcgagtgaaatagaaaacatggaacagttgtgcgtcctcacactacagcactagtacatcttcacactacagcacttgtgggctgcggggccctgcaactgccagtgctggggcccggtcttctgagccacagcaccacgtgcagcagggacgtgatggctcaccccgctctcccctccaccatgagcgcacccacctttcctcaccctgccagggcaggacacacctttgggggcgccccaggacatccaggttttgaccccacaatgctcaggaaggatgacttgtgagtggaggctgggccattctggggggtatgctgaggcgtgagcccaaaggtgacaagtgacacatgagagcaagtggcaccaggtgccattcactcagctctgcttgggaagcccccctggggtggtagacagtgtcatgctctggtattctgtgctgtgaccagggccacctcattcccatacaggcccccagatcagtatctccaccaaccatactcaccatgggtgcaggaacatcagctcctctcctcctgagagtcactgggcagcgtgggggcaggcgagctggaggaggcgcagcttctggagctgggaggccgggtgctcctgcccgggagcccaagggcccgtctgacctcagagagcctccttatcagccgcggggagggcgatctatcacgtggcccatgctggtgtggaaggacaataaagcagatattgaccgtgattctaatcgggtgagctgggcctctcagccccacagaacacagcatgccgacttatgggttcagacgcgagaggagccaagcctgagcaggaacgagataagaacatgccctgggtgattcaatttaatgcaaccgtcgctcccagcaaccttgatttgctaagtgctggggagcccagagacgaaggagacagggggccagcatgttctggtctgacagcaggcacagggcctcgccctggtggggtcagaaggctaaggggatgtatgtccttgaatccactgggcagggaagggcaggggggtatgtgcagctgcctggaggaaaccccaggccccactgagccatggggagcaaggccctgaccagcacttgctgcagatggcccctgcctggagccttcccacctgctcctctgcagatgcctcccctctccctcaccaggaaagtcagggtatcccgactctgtcccgtgccaattatgtgctgtcatccagcccctgcatggccagtgccaccatgggccggtgaccgcgacaccctccacccacgagccaaccacacactctaagcctgcttgaggcctgtggcacctggtaccctgggggccagaactgttccaagacccaaccctgatctcctccctgtttaaactggcttattcctgctacttgggtctaaaaccctttgagagctgggcatggtggcacatgcctgtaatcccagcactttggaagaccgaagtgggcggatcgcttgagcccaggaattggagactactctggagaacatggcaagatgtcatctctatcaaaaaaaaaaaaaaactaaaaaatgagccaggtatggtggctcatgcctgtaatcccagctattcaggaggctgaggtgggagggtcactcgagctcaggagtttgaggccagcctaggcaacaaagtgagacctcatctccataaaaactaaaaaatttagacaggcatagtggcgtgcactggtagtcctagctatttgggagactggggcaggaagattgcatgagcccaggaggtcaaggctgcagtgagccaaggtcgtgccacttgactccagcctgggcaacagagcaagaccttgtctctaaataaataaataaataaaacccttcgagacccccacaccatcattccctcatcccccacctaacccaaggatgccctattgcccatcttcagaatgcaggcaaccctcacctgcattccttcctcaactgcatgcacccccacctgacccttcctcacctggacacattctcacccagctctctccctggcaccatcccctcagctgtcatcctccacagctctctggagacaacttcccccgtgtctcctagccctgccctgccccttcccgcagcagcagaagtttctggagtgtgcactgggtcccgctgcttgccagcttggtcttgctgccatccaccatggcagccaggccaaacccaccctcctccctcctctaaacacccctggccggcacctgcttaccctacagtctcatctcctctctcacctgtcacatgctccccacatgcagctcttgccgcctcaccaggttccttacattcaccctatctccgggcctctgcacgcactgtgccttctgtttagaagcatttatcctgcattccttttggtcaccttccttcctccatgcagaccttgtccctggggccctccctctggcccagctgcagcaactcctgcctagagttcctctctgtaacgcacttaccctgagtcaattctcgtgcttgtgtacgtgccccttgccccacaccagctgctccattcggtctcatccaccgttacacatgccacacccacagcagggcctctgaggcacccagtgccacagccacaccagctggatggctctctgtgcctcagcctgctcatctgtaagatgggggatcattgtgcccactcccagggctcagtgagggatgcacccaggtctttaggacatgctgggtgtgatggttcttcactcccttcgtggagagctgtgtaacctgcttgggatgatgccatcaggaagggcagatggcacagggtcataaggccacggacacccagctctgcttggagcaaaatctctccagggcactgagacagaggccccccaaatagcccgcctgccatcttccctcacgcatggtccctgtgctctgcctggcccacgccttttttggctggggctcaggctctctgtggagtgggggctgggggagcaacagaagaggccttgttgagggtcccaagggtccccacttacatgccacacggaccccagtgcagacccatctcccaagagccaggtccctgattggatttagctctggcctcccagcacctcacgcccatatcccctggcctgtctctttagaggataatcagaggaagtaattctatttgagaaacaatcactcctgtggtatgatggtgcactcgatgttaatggacccagcatccttgcatactaaggacgcatttcagccaagcacagggtgtttttcgagaaaggtcttgttccccatcaaggctctgccctcactgagctattagcagccaggctgaggacatgagcttgaggggaggtgcagactcagaggtgctctgtgcactgggctcctttgggcactggcagacagggcagaagttctgcctggggaactcgggctctggcaggtgttctgtacacccacctggcataacatcagcctgccctggtgccatttccattatcagtccatcttacaggtgaagacactgagaataagagaaaaaaggaggatgtccgtatccacacagctggtgagggggagctggaaaccctccagaacattgctcccgtgctcccccacttctgctcaccctctgctgactcagtttcccactttctgcctgctcgtggtgctgcacccgctgccaacataactgtaaatgcaaaaatgatgatgccacaccttcccacaaaattcttcaccatgtttccaaggcctacagaagacgctggagctctgggatgccagtgcatgggcacgcgccaccaagacaagccccctctaccttggacccatctcctggccaatcatacctggcaggcggccctggcccagccatactgcaccccctgcagggtcctgttctggcctggggacttcacacttagccttggcaagtgccacccccatgagggaaaggctccccccacccctcgtgtcctatctaggtgacagccactcgcccattcaggaggattctgcctgagcacctcttccccgtcaatgtcactccccgagcctgggcctgccacagaacctgccacgtccacgcaaggtcctgctcctgggtctgctcctcatctgagcggaggggagaggcttctccaacgctggagagagtgcagcctccggcagcctgtggggccacagggcctggcctgcccagctttctccttcattcattcagcacatacccattgaggtcccactgcctgtcaggccctgctgtgggctgccataacaagataggttacaccggcttgagcaaacagtcatttctaacagttctggaggccggcctctggactgggttccagcagggtcagtggtggtgaggcctctcttcctggtttgcggccggctgtcctctcatgacatcttcccatggtggagtgagatcatgccccttgcatccctccttataggtgcactaatcccattcatggagtctccacgcccatgacctaattccctcccacagccctcacacccactgccatcacgctggggtttgggctttcacatatgaatgggggtcacagataatcagcctagagtgggcactgggacacagcagtgacaaaaagacaaaacctatgtccccgagggcccacatacccactgaggacagaacttgccgaggtgatgctgagccatgtggacacctgggggagatcatgccaggcatgggggacgccagtatcgaggccctggctaggggtccctggtggatcagtgaggtgcccaagagagcagcacatggctggagcagtggcacagtgggttctgacttacatctcaggagaatcctgttgtctcgggcagagaacaggaggacaggctgcagtgctggtggacaggaaagtgcagaatgggccactgcagagatgcagcaggtgggcaggaggtgaggggtcagattctgggaccacgggaactgctggtgcgtggggtgaaggaaatgagagaagccagcacccagggagacgccaggacctgtggcctgagaaactgggagtgcagggctatcatcagctggagtggggcgagggcaggcctatggggaaggaaatggggacaagtgccttttgaatacctactggatgtccaggtggacttgtttgtaactggacattgtgagcctgacctgaggttcctgccctgagcccccatccccggcccccttgcagggtcagtgaggcacgagcacaggggtcagtcctagggacccaggcctggccctcaggggtaactggtgcccatgttgccctcaagggctgtcccctggtcttggagaacattccctgagagctgtcccctggccaaggggaagtgagggacacactagtgcctctcatgataccttggctggagcaggggcttggaggggcagcctggggccctcaggttcctgctccccaccccatgcatctcagcccttcactcccagggaagctgctgcatgccttccctagaatctgtcccacagggggtgaactccctgcctgtcaccactgttgaaggatgacttttcttctctccacaagccagggaattaattcatgccatctattttactgagtcggatcaaaggttgtcaaattccttcacccacttaatgatctgtaatatacccttccatttcctgaccaggctattagataaaatagaattcataatggcctcctggcagcatctgtgcacctgtgtacatgtgcagggtcagtcaagagaccctaggatctgctcagccaggatgtatctttttttccaagagattctgcaaatctcaatccatatggggcttttagtgccaaacatactctatggtctgtgtgaggctgaaaatatatgactcacgagtcaccactgcccttgccctgtccgtggtagacattattaatcaattacaggcactcttcaccactgagctcagatgtagctccttccacagccatcacacatgatacatgtcctggccggggcaaggaaacctcctgaccatccagatgagagacattaattgatgctgctcaccacactgttgtttctccttttttttatgtgtacggtggcctctgagcaggggtaatatgaggtgaccaggatccccccgctgagcctcctgcaggctgcttcagtgggcacagcccatgatcctactccacagtcaggaatgagcaccccaaacctgccaagctcccacctcacaggaggtctattgtgtcagcctcctgagctcctaggcatgaaagcaccttgctggacaaaggcagggattgctagcaggcagcagcacacaggcgatcatgggaagacccggggccctgcccgatccaccacacacccacacaccagtcatgctccatcctgtcacaatatcaaagaggaagcatcaaggctgacagccacagctgaaaagagctgtgcacaaccgccaccttggtccctgtgaggggtctggtcactggcctgacggtgacaccttctcggggtacagagtcccagactccctgttgttcctgtcttgggagcagtattggcgctggcctcaggccacctgggcctctccactcccttctcccctagcaggcctcttgctcagagctcctacgaggtctcctctcccagctcctctgagctgggctgcaggctgggtgtgtagagaagagcagaggaggctgggagagctccctgaagtcacgttactgtctgctcagctcagagagaagagcttcagagacagggaggactgagttcaaagggaagccctggggctggaggtgaccctacctggctgccgcagaggactagccacatgcctgccacatgccaaccatcgtcccctgtcactgcagcctctgtcatgtcagccttcagctccctggagcagtgaggcgggctgtcctcgcccctgcctcgacctgagccttttaagcaaatcagcaatgtaattattgatctgtaaaagaaaaggaattaatatggccgcccacatcctttgtacataagagtatttaacaatgaactctgcttaaacttcataaaagcctcttcagcaaatcagcacagaagtatcgatctggaagctggcctgtgaattccagctgactgcctctcccactgaaggaccattacttggtcttaccgaatctcctctctccatttatggctgggcgcttcctcctgggacgcttctgctgcctctccacagggactgagctgcccagttttgctgatcctcccttttcctggagtccagcgtatcgactggagagagtactggggaggtgctcttggttggggctctgcagccaccctgggcctaacaccccaggctcaggcctgccctagagacccttggtcaccctgcttttcatggagcagaagctggggtactcggtgtgcaccctcttgttcaccctcccaaatgggcattcttgcttcaccttgcagggtcacccagatgctgggggctggggccagccttccagccaatggctgagcgctttccttctcagatatgtgagttggggctggcatcacccacaatgtagcaagctggacccactgccactgaggccgtgggctctccctaatgggatcttgtccaggtacccgaggaggccagtgagtcagcaggctctgccagagcacccaccagccctggcatccagcaagatggctttgcccttggagccttcccatccaccctgggcccagcctgccagttactctgagcctgtggctgtgcatctggcctgggaccctgtcctgtctgctgggtagtgtcagggtcccatgggagagtcagtcctatcttgaagcaggactctgagctcactgccagctgctcagggttctcctcggctgcccagctctaggagcagaggcctgaaccctgtgacctctgtggggccacttgcagatggggcagggatgggctggtggatgagatggggtggctctgcagatggggtgggggatgccgacaactgaggcagtgagtgcagtggcaggagttggggtctctgggttgggcctcgtccagggctagcatctagggggtccagaacccccttcctctctggccaccatggctgcctttgtgaaatgagctctggccttggcctctaaggcccctacagccctgactttatgcatagcagcagaacagggtcagagagtccaaaccacagaccccacgtcacaggccagcccctcagaaatgcacagtgcctaacaggaacagagcctccaacacactgggaagtggctgtggtggcgtccgcccccgctgatcatgtcgtctgccctgcaccctcccacgcctctgcactggatgcaagctcactccacatgcctctctctgccgtggctcctgccttgtacctcctcctctctgtctcattcttcttgtctttgcctccttctctgtcagtttctttgtttctattttcttctctgctggcccctgttttccctttctctttgtctctttctgatctttctctgttaatcctgacgttctggttgtctttctggccacccccacgaccactcatgtccagcattccctggatcagggtgggtgaggctcatgcccaggtctcaagaggaggtccgggtgctgggccctgcctggcaacttggagaaggctccccttgagaacactcactcctccagggggatggaggctgtgggggcaagctcttctcagagcaggtgcacagcagtccctcctggccctgcaggtcttgctggttgccctaccatgagccacatcttggggccggcagtggggaggaggagacctctgtgctggccatgatttgagggacaccagaggactccaagggtgccccacctcacagcatcccttccccaccttcctccaacctgctcctggctgccaatggccaggacaggtcaggtcaggtgaggggtgatggggaccaccagagggctgcaggctgccaccccctccatccagctgccgaccagctgggagaggtgctgtcctcacactcacacaaagccttggtgagagaacagagagggatgcttgcatgtggcattgcacccctgggaagaggagcaccccaggaacttggggtccatgcggtccatgcctcggggccctatagcctggagtctaggtccccaagctcctccaggccaccttgagggcctctgccaacacgcactgcctcaggagggcatgcaggccacagacaaggggcagggcctcagctctcactagaaagaagccgaggagggggcctctgaggaactggcgggggtcccacaggcaggacagcccaaggtcatggcctctaactcagagggggcctctggaagcgccacgttcactaggcacgggctggaggcagcccgttcactagggcggtctcccgaagacgtatctgttgcaggggcagcgagaattccaggggaactctagaaaatgagtggcacctgccctccttgtgactggtcaaggaatattggggcctactgagcatgcttggggtaccctcctctgcagatagcccatgcaggtccaggggcctgatcccacctgccacccccaggctgggagactcagagcccatcagtgctggtgtcagaagaggtcgcccctttcctgacccctctgcttcctgccacccggagatcaaaaggtgtctcctcggcggttcctgtcaccagccttaatgcacgctctccccattagcacaggggctgggaggggaggcagccaggggaagatgggagcctcagatctgagcccagaggaaggagacaggggtgggaggtctagggaagattcagcgataggcctgccctcctgcggccctccagacaccagtcttagagccctcctgcatggggagacatggggcatactggggaagggtgaggtcctctctgagccccaccagccctgacttgactgccgctctgtgctgagtgctccccgcacacggctcctggtgacagcacccgtgtgctagtaccgagccacagggtggtcacagatgctgtccgtgtggtctccagcccgtgtcagtggggaagggcccacagtgcttttctgaggccagagcactgtcattgcccctcgaagaaccagctaatggcagtttccagactagaacctggtctcctcgtggcctgtgcagggttggggtgctcagcccagcctcagggggtcacctacaccccacccccaactgcccgtaggcccagggagctggagagcttccctgcctgcttgcaggcactcacggccctgtgacacacacacactcatccccaatgaaggtgcacccctgaccaggtgtggaccccaggccaggcagcaaagagacagctggcctgacttgggtcctcagcctggcccagccccagccgccggcttgagcaagcccttcccgagaggtcaacctcccatccagggcgtgagggttgcagcctgatcccaccctgctgcatctgccctgtggagccctcgtcctttttccctggggtctccctccccgccaggccaggctctaccctcagggccggaggcctcctgggggaggttcatgtctcactttgcagcctccagccagatggcctccataattcattttagtgaaatatggcaacacttttattggcgatgatcctatctggagcctggggacagtgatggccagaccagggctggtatctgctttcacagagctccgagaaaagcctgcatggttatgttcgcggatgtgcactcatttcgcgttgctgggagggggggtggggcagggcagaggctgcctctgggtctcctgattccaggcagtctggggcaggaggcccacaggcccctgcactggcctgacagaaggctcgggcccggggcagaggggtgggctgcaccctgcactgatgctcagaccaagctgagaggtggagaagtcaggggatatgcaaggtgatggggagcagctacccagagctgtggggtggaggccatgggtgccactcagcccttggaggagctgcctcccaccacctgcagcaccagagtggccctgctgagctgcaggctttctccctgcatctccagctcacactgttgtgtgctctgtgccccagggccagccccataggattcagaggccaacctcacttcctctgcactagcagcccagagacccctgcctgatagatgaaccccaaaactgcagtctcagtaggaccttagttgcagtcacaagtccaagaggaagaaggagaccccattcctggtcatgctgtctgccaggctccagcccgtcaccccttaccgtagccagcccagacctggtgcatggtggagcatctacaagcagaaggtgaggcgtccccaccatgggtctgctctgcagccctgcggatgtctcaccagcctgtatggggtgtgctcctggggacaccaccttggggctcctccagggagctgaaagagggcaggcctgggggacacgagatggacagggacctgagaactgcccatggcaccacccaataagcctgcacctatcccttcatccaaacaggtccaggaaaaaggcaattacatccccaagaaatgtggccagtcagggagcgtgagagcttgtgctgctcttgggggccacagagacccacctggctggttctggatgagacaaaggctgcagactgacacacctatgcaactctcctcctgcccaggtgagatcagtcccaagtgtcagcatgtcagccacccccaggagggtcctgggcatgttatctgacctcgctcaggcagaggtgaggctcagcgggtgactggggcaacgagacccagactagcgggaggcaccagaagggatgcaggcctggacagggtgggggctgtgaggccccaagtgtgcccggccaggacacagctgtgctttacttcccagaacggatggccaaggtggtctcagacaaggctgtgcctctgagctacattcccacagagacttcagggtggcagtgcagcctcagcctgcgccagcacccccaggccttcccgaggtgcctatcgacctgctgaacccagctaatgggctcctctgggcattgagttcagaggcgaggttgcctgtaagcaagattcgccagtgtgcttcatcagcaggcagcctcatgcaatatgtaacaccacattaacctgcactctcagggtagacagagcccccgccccggaatccggaatccggaatctgctgctatgtagaagtggcctgggacgggaggcagagcctgcaggccctgtccttttccctgtacttccatctccccactctgtgtacatggggtgggcagcaaagctggcgcttacaccatggcaccctcccctccacctatggcaggccttggaagtcaccggcaacccctgcccctccaaactcagacacgtcctcaggatctctctcaacacagtactgcaggcaaccacaactgggcagcccaagtgggtgagcaagatcaatgcggaattgcaaggggcctcaagtagcaaaaacaaccttcaaaaagaagaacaaagtcagaggagttacactttctgatttcaaatttactacaaagctacagctgttaaaacagtgtaaaactggcatagggatagacatataaatcaatagaataaaattcagagtcgtttaaggccagttaatttttgtcatggatgccaagctcattcaatggggaaagaacagtcttttctacaaatgttactgggacaacttgatttctgcatgcaaaagatgaggttggacccctacctcacactataggcaaaaattaactcaaaatggatcaataccctaaatataagagcaaaagctgcaaaactcttagaagaaagcatagtggtagatcttcatgaccttggatatggcaatggattcttagatatgatatcaaaatctcaagtaagaataacaataacaacaaaaaacagataaattagacttcatcaaatttaaaacttttgtgcaccaaacaacattatcaagaaagtgaaaagacaaccacagaatgggagaaaacacctgcaaatcatatatctaataatagtttaatatccagaatatataaagaacttctaaaactcgaaaacaaaagaacaaaacaaccaaatttaaaaatgggcaggctgggcatgtagctcatgcttgtaatcccagcacattaggaggccaaggcaggcgggtccatttgagctcaggagtttgagaccagcctgggcaacatagtgatactccatctctacaaaaaatacaaaaattagccaggcatggtggcttatgcctgtaatcccagctactctggaggctaaggctggaggatgacttgaggctgggaatcagaggttgcagtgagatcatgccactgccctccagactaggagacagaatgagaccctgtctcaaaaaataaataaaaataaaaataaaataaaataaaaatgggcaaaggatttgaatagatgtttctctgaagaagatgcacaaatgccaataagcacatgaaaagatgctcaacatcactaatctttagagaaatgtaaattaaagccaccatcacttcacctattggcatggctataatcagaaaagctaaaagtaacaactgctggtgaggatgtggagaaactggaactcttgtgcattgatgatggaaatggaaagtggtataactgttgtgtaaaatagtgtggtcattcctcaaaaagctaaatgtatagttaccatggaattgtgacccaataattccattcctaggtatatactcaacagaattgaaaacaagaaatcaaaaaatgcttgtgtcccaaagtttatagcagcatcatccacaaaagccaaaagatggaaaccaggcaaaagtcaaccgacagatgaatggataaatacagcgtgctccaccacacggaatatgattcatccgcacaaaggaacaaagttctgacacacatgacaacagagatgaaccttgaaaacattatgctgagtagaataagccagacacaaaaggacaaatattgtaggattccagatctaaactaggcaaatttatagagacaaagcagattagaggttaccaagggctaggggtgggggatgggaggttattgcttaatgggttcagattatctgtttgggatggtgaaaaagtttgcagtgcacaagagttccagttttggaagtagatatcagtgatggttgcacaacatcgtgaatgtaattaatgtgaattatacacttaaaatggttaaaatggcatttttgtgatgtatatcttttgctacaaaaagaaccattttttaaagaagcaatggtgagcaaagttggtaaatctgtaggtagatccaataaagccttgacaattcaaagaaaagtaataattaatttatggccatacaaacagggtgaggctagtactccaaacagcaaagcctagcatgcccagtaccgggcaaagagcagggggagacacgggctgtgtctacacaaggagcatgcctttctagcacaggtattaaaactttaggacaatttattaaagaaatagaaaatatgatctctgtgttagtttcctgtgattgctataagaagttaccacaagtctggtagtttataacaacaaaaatgtattctcttgcaatcctggaggccaggagacagaaatcaaggtgtggaggaggcagagccatgctccctctgaggctcgggggaggagccttcctggcctcttccagcttcccacagctggcatcattcctgagctgggccatgtctctccaatgcctgctctctgtttacagggccttgtcccctgtgcaggtctgggtcaaaactccctctgcttctcttttataggatacatggtatttagggccctggatgacccaggacatgctcctcctctcaaggtccctcactcgatcacatcttttgcaatacaggtgatattcacaggttccagattagacatgggtgtatctgtgggagtcatgatcagcctaccataacttccaagcaattgggaagaagaaaaagaatacagaaaattgagtatttctaatagaagttaggaaaggagagagaaaatggaagtccagaagccaggacaaaaaaataagtggtggaaataaattttcctagatccagagaaaacagtaaccatgaatgtactgaacagagactgtcagattggacacaaaagcaaagtcttgtgtcagacgttgcttacagaggtcacagtgaagtatagaaaggtagaaggcaagagggtgtggaaagccgtggagtgtaaatacggatgggatgaaagttggtgtggccgggccaatccccaacttagacttaaagacacagagaatccctgggaatggagacagcgactcccagatgatgaagcagcagagagatcctccaagggtgagtgacctagagcactttaccagctttgtaaaggaaaaggcatttgcctggaggctgcagggcccagtccagcctagctccaggacagctccaacccatcctcccatgggtggggtgtccctggtccaggctagggacggtccagggtgggttggcaggacctgctgtgatcgtgaagttgggaactgcctaaaccatcttctcagagcctgtgtgtccagagggaaaacccaagcacgtggaatatggtttacaagccgtggttgctgaggacaaggttggtaatgaaggcgcagggaagcctgggagggcagaaatgcacaaggaggggtggggctggagcccggctggtcctggtatcctgggcttggggggaccctgctcctttccctgggagccctgaggcctcaactggatgacaggaggtggatatgctggtccctgaggcacaggcagtatgaacctctgcatggagctgggtctcagcagaagcccacccaagcctggagtttcccagccagggatgcacctttttcatcccagcagcctctgtccctcagtcctgagccctcaggggccctcagggcatgaaagcaggaatcccaaatccaccttccagaattacacgggctgttcttggtggtcaggtggcctctcggggccagggtcctttttaagactggaacctctccaagctcaccagcactctcagtgcacgcacgcacgcacacacacacacacacacacaccaggattttaaactcagtccaacaaatctcagcatgcaccagaactatttcagcattttaagagcctgtattgattttggaaggagccaggcagcgtgtgaaggccattctgtctgggatcctatgctgagtctggggtctctgtatgagggattatccatgtgtggggagccttcccccttcagagctttccagcttccctctgatcacatgtcctgagcacactatcccaaacctaaccccagctgggctctagcaagagacgaggtcctgtcttgctgggaaagggtcatccttcccacccggaggcccctgctctgccccagtttcctgccacaaagcccagacagtcctgggaacctgggctggtgagtccctccatcaccttcagaaacagccatgaggagctggcagtgggatggcctgggggtaggagcgtggcttctggagctagaccacatgggttcagatcccagcggtgcctctaactggccacaggaccttgggcagtcagctgaccctgcccagtcccagcatcctcatctggtcttagctaacagggacacacctgaggaggtggtcttcatgtcacttccactgggaccagttttcagagcagctgcaggggtcatcagttaaggcagtacagcccacttacagaggaggcgggtggcttggggtgtgaaggacgtgcccaggtgacatgctgctgagtggccccaaccccatccaggcaccaagccagagcctgtccccagggaccccagggcacatcagcagaagctggaggatgtgggtctcctgggcctggaatctcagagcccacattggttaatttcacacgtccgcttgactggcacacagggggcctggatgtttggccagacattatgctgggtgtgtgtcaggggggctctgggtgagatgaacacttgaatccatggactgcaaagcagacagcctcccagtgtgggtagacccatccaacctgtcgcagacctaagctgaacacaaaggccaagtaggagataattcattctgcctggctgccttaagctgggagcttggtcttttccaggcttcagacctgaaccgaagtacaggctcttcatgcatgtcaagcccctggccttcagactgggacaaactccatcagctctcctggggctccagctggccagcagcagatctggggacttctcagactccactatctcatgaagcaattccttgccatccatctcctttaataaacacacacgcatcctatcacttctgtttctcgggaaaaccttaactaatgcagagcccgagagtggggcatggctcagggctgctgcacccaggaagcatctgtgctccctgtgcttccaggcagggaccctcatggaggggtgggatggtcgtacttcctcagccagcacttaggggccgtgaggtccatagccatgagctgagggagtgaccccacagtttatgtcactgtggagaaaggctccctgagctgtggatccagccagtgggttgtaaacctgactaagacactcaagctgctgcggccgggggcatgccacaaacccccagtgagcctcagtttccccctgtagaacaggggtgtgagagcagtctcctcagggtgtaaagagcccagcaaatgccgggcacagctcataccagataagcattagctggtggcagaaaagctggaagacagactgctgacctccacaaaaggatcagatttgtgccagtcctggccatggacaacaggtcccaggcttgacctgtaggtgaagagcccagagcccaggaccacatgccaagtgggaggctcctggcccagaacaccacacctgcctagcagatgtgtctcctggaagtgggaaagcaggactctccagggagccctggggatacagaggatgcagcccgcgaggccctggccttgaagccttagtgtctctgcaggccccacctgtgattggcccctccagggtcacccaggagggtaagatgcccagggcctgcatctgtgctgtgggacacagcctggcttctgaggcccatggaaacctttctcgggagcttctcaggaccccagccaggacatctgtgcctgtccgtgacagctgccctagaactggccacaggcctatggctgccttgcactgtcagcccccaacgcccgtcgtgtcatcagcatgtctcagatgccttcaagggctgcccactccatgatccttgtccacagccccagcatgtcccctagcgtcagaagtgtccccggatcctgcaagccaaccacataggacgtccacctctgagcccctctgttctcctaccctcctgctgatcacagccctgctgcctggcctcatggtccagtgcatctttctccctggagctgccacagtgcaccacctgcctggctatgcattggtgacccctaggagctccagggggaccttcacacaggcccaggacaactggggagtcctgcctgccctcctttgagtccagaagccctgagccaggctctcttcagaggggtggaggtcagcaggcaccaaggcctgcagtccccaattctcctctcccagctgatctctcttgccacaccctgtgctggcccatgcccgtgagtccgcctggccacccagacgggagctgatgtctccaggagacatacgggacttgccatagcccaggccagggcagtccctgggagacacagggcctgggaggctgcttcacctgcggggctcctgggcaggtgcagtgctccctggagtccatcctgggacctgtggcccagcccacctcagactggccacaggccctctcctgagaacccctgcctaggctctgtagccttagagcctcacctagaagctcccccaggcccctccactgggcagtgctcagcgcccacccctctctagtctagattttagggggagcctgggtccaggctgcccagcccagcacatccccaatacatacccaagccagccatgattgcaccatggggccaggggcagtgggggtggtttggggttggtggaggcatcagggcctgggtcccacagccagcctgggcctcccaggccattgagccctcatccttccagtgctctgcgagcaggcgtccctttgtgtgaggacacctgtggtgcaccccttcagtcaggcatccctgcaacccacttgggggtgcagacatgaaggagcccatgggaggcagcatgatggccctctacatccccaggctcctgtgctccttcctttcagatggcattcattgaaggggcaagtggaagaaggacgggtttcccagcagatgctgcaattcagcccctggcttgggatttgtgtcattgatattattgataaacagagaacacaggttgacaaaagacaagagaggccaccagaaatccatgaagacagagcctcttctggagagagcaggctgttggccaccctgagacccctccccaacttgcgcctggcctggattttgcaggggacggggctggggagctggtgctggtgtagccaccggccctgacacccagccgcgtgaccttctctcgtggcctcacagtcctcccttcaagggtcccaggcctgcccctcgaggccctctgccctccaggagcgcccccatgtccttcccagcatgggcagtgccttacagacacaggaaggctaatgtcagtggagggacacagtgacaagaggaagaatgtgcagcgcccttcaggagcgtggtggggccccagcaggggaggaaggctccaagggggatgacagcatggctgtggcaacgacagttccatgatggcagtgggggtggcggtgggggtggctgacctaacacaggggaggtaactgtccaacaggagccaggctcagccaaggagtacagccaggaaacctccccttccctccccctgcacaccaccctggatgaactgaggggccacccaggcactggagcctctgctgctgtcacagagtcaggctttgggcatggagcagctggcagaggggtgggtgctgaagggcaagtggactccatggagagggccctgatacggggaggctctgctggtctccgggagcaggtcaggacctgagcagactctctgggctcctcaggagaccacccagggcacacccagccctgcaagggtctctacgtggtgccgtcagtgccctgcaccccctggtaggctgcccacacctgtacctgctgccccacccagcaaggctgcagagctgcgtggttcatgcccacctccaaggaccccatggggctgaaggagacagcagagctgcccagctgcaaggttgtcagaggacccctgtttttctgtatttctgacagtaggagatggtgccattgctggaagatgggcctttcaggctggcacccagccccgccccagggggccacgccacctcccacaggctcctgcatggtgggcatgtcccaagccagcctcatctggccaggttgtcactctgggtaaagtgaggtggcagccctgacctgccagcagcagacagtagaattctacagagcatccttcaggctccagggaaggacagagccctgagcagcaaagactccaggaggcattgtggctttggaagcttttcttcaaagcttccaagcccatgttcaggccactttgcacctgagtgacagcatttagctttctttgtgttaggagaaacccatggattgactttcttttcctatttcctccgggggtgaagtatcataagccaggaaaaagtgggtcagggactgtctaggtgaccctggagagcctcgccaggagctccaggggtccatcaagggcaatgggagcaggaggggtggtggccacttcttgatggtgaggggggtgatgaggctcccttaggccctgaaaaggtcagaatggggggtagggagccacctcctgcctggagcagttgatgctcagagctgctcccatgtgtcctcatccctccttccaggtaatggagccatgggtttctaggggaatccagggctctggggagactgggattctgactttgatctttgactgactttgatcagttctcgtgtttttcctgtgcattttctgatgagtttatatctgtcaggagcctcaggaccgtgctaagcccccaggatctgagggtaggaaaaaccatgccttggatttcctgcagacatttgaccatggtggaaggctcaatgaaacttccacctaaacttggcagattgaacacttcattgattttcactctctcccagaatcctatcaaatgatcattagtaaatagagaattccaaaccctacaaagaaaaatacaagcaaatgaacaatgaaatcagtcagagcctaggaggctgaagcacactctgtgggcctggagggcagatggtttcgaggaaacagccctcaatgccacagagggaactggaggagcaaagtgactgaacccccagagctggaacgcaggcccccagcccagcctgtgggaggtgcagcctcattcccaggaaagggtgagccagagaggccctgcttctgggcatatcaggtacgtcccaagaagagggaggcaccaggttggggacaggggagtgaacgtttgtctgggaagcaaagacacagcccctcccgttctccaggaggcagcagcccagataccagtggccagtcatgggctcctcagactggaagtgggaggacttttctcgagggaaactgaacaggcccagagaagagacagtgaaggggaacctttaattaagatgctggctcatccatcacatctccctaaagaaagcttccaatccattttttaaaaataagctttttgttttagaagagctttagatttacagaactatcgtgaagatagcacagagagttctgacacacaccaccccagctcccctgttactaacatcttacattagtaaggtgcatttgtcacaactaatgaaccatgttgatgtgttggtattaacgaaatagcatcttttattctgatgtttttagttttgacctagtccccttttccagttccaggacatcacatgacatttgctggtcatgtctcttgggctcctgatggctgtggctgtttctcagatgttccttgttttcggtgaccttgcgagttctaaagagtgctggccaggtgctttgtagaatgcccttttactgggatttggctgatgtctgataagatgaagatagtgtgtcttggggaggaagaccacagccaaagtgtcactctcatcatgtcacaccaagggtatctgctactaacataatttttcactgtttttttacattttagatccagggggtacatgtgcaggtttgttacgtggatatactgcataatgctgaggtttgggcttctactgaacccatcacccaaatagtgaacacagtacacaacagggagtttttcaactcttgtcccccctccccttttggagtccctagtgtctattgtttccatctttatatctgtgtatacccattgcttaactcccacatataagtgagaacatgtggtatttggctttctgttcctgtattaattcacttaagataatgacctgcatcctagctgcatccatgttgctgcaaaggatgtgattttactcctttttatggctgcatagtattccgtggtgcatatgaaccacattttctttatccagtccacagttagtgggcacatagattgattccacgtttgctactgggaatggtgctgtggcttatcactgtggatgctgaccttgaccccctggctggggcggtgcttgtcaggtgtctctgctacaattactcttccacactgcaccctttggaaggaagtcattaagcacaacttccacttcgggagtggggagtttcgctacctgaccttaagggtggggtatcaacataatttgtttggaattctcctgcacagaatatttgtctttcctcccccacattgatttatttattcagtaatttattgatgtcaatatggatatttattgtataacttgggttataatctgatactactttattttgttgctcaaactgttccagttttggctgttgggagctctttcagttgactcctgtgtctcttttgcatagtcctatcattgtgggttgattttttgtttgtttatttgttttatcatgttcttgctttctggtgctacaaagtgctctaggctcaacttcaatatttcttgccacattcctagaaacaaccattctccaaggatctctggtttctttcactagacaatggtattaaaaaccaagatatgggtgctggggatgctcatttctactgggggcattgttgcttctaggccctctcagtggacagagcaaggaaatctgtatggatgctcacccatgtgtgtatccatgtgatggttaattttgtatgtcagcttggctaggctatggtgccaagttttttggccaaacattagtctagctgttactgtgatagtattgtttataggaactaccctttacaacaccggtaggtctcatctcatccaatcatttgaaggccctaagagtaaagactgaagcttcctgaagaagcaattgtgcctccagactgcagcatagaaaccctgagtttccagcctgcaaatttcagactcaagactgaaacatccattcttgccttaacttccagcctgcaggcttgctctatgtatttcagatttaccaggtcccacaatcacatgataggagtcagatccttaaaaatttctgtgtgtctacatgcacacacacacacaattagttttgtttctctggagaactctagtataacacatatctatgtctctatctatatctacatatctatattaagctaaacgttagtccacatgatgtctccccctctaatctactatcgcatggatcattctccccttccagcacccttgcttcttctgtaacctcccactcaaacagcgagatgctggttcccaccatccaccagacacttatcaaattgtctgatccacatgtatagtggtttcagaattgttaacccatacttctgtggggaaaaactttgccaaaaataatacagtgcttacgtgcctttctgtttgtctttagtcttagaaaaatccgctaattcccaaaattacttaggtcagcaccgtttctcccaccctcttcaaatgagattatttcatacatttgtaatgcagttacattattttgtcacattctgcattccatcctgggatctccaacatcctacatgttaaaaatatacatgcatttgtgtcaagttctgtgtattttgacacacgtttaatatcttgtattcaccttcacaaaatcatacagaatagtttcaccaccttaagctatttcctgtgcttcacttgttcaatgccctactcccaatcccctggcacccgccaatctgtttaccatctctacagttttgcctttttcagaagatatcattggaatcacatggtatgcaattttttcaaactaacaatatacatttattaaagatttattcatttcttttcatggcttgatggttctttttttattgctgattaacattttattgcatggatataacatagttggtttatccattcccttgtgaaaggcattttggttgctttcagtttttgacaattgtgaataaaaccactataaacattcacgtagattttttgtggacgtaagttttcaatcagttggtaaatacctaggagtgtggttgctggattatatggtaatcctgtgtttaactttataataagctgccagactatcttccaaagtgactggcccactttgcattctcaacatcaatgaacgcgagctcctgttgctctctattctcaccagcattaggattgttcatttttagattttaggtattctaattggtgtgtattagtatctctttgttgttttaatttgcaatttcctaatgacaaatgatgatgaacatccttttatatgttattttatgatctgtatgtcttctttagtgaggtgtctgttcatatcatttgatgatttttaactgggtttttttcattgttaagttttaagagttgttttgtatattttgtatacaggcaatttatccgatagatgttctgcggaggttttcttctagtctgtggcttgttgttttattctcttaagtgtcttttaggaaagcagaattgtttaattaataaaagtccaacttaccaatttttttcttttttttccaacaacctcttgtccaacagaacctttttttttttgtcttttttttttccattttgtggagaacaggatctcactatgttgcccaggcaggtctcgaactcctgggctcaaactatcctcctgcctctgcctccctaagtgttgagattacaggcatgagccaccatgcctggccagaacctatttttaatggatatatttgccaatatttggatgagtatttttgaatctatattcatgagaatttctggtctgtggttttcttttcctgtaatgtttttatctgtttttttgaattagggtaatcatggcctcatagaatgagttaggaaatagtccctcttccattttatatcttaaatgtttggtagaattcactggttcttgtatttgtggaatgttattaattattgattcaatttctttaataggtataggcctattccaatgatctatttctgtttctgtaagtcttagcagcttgtgtctttcaaagcattggttcatttaataatgttatcaaatttgtggtcatagagttgtttatagtattcctttattatcatttaaatgtctatggaatcactagtgataactcctctttcatttctgatattggtaatttgtgtcttttctctaacctggcttttggcctacgaatttgattgatcttttctataaaagatagttttgtttttttcatcttttcaatttcattgatttatgttctatgttttattatttcatttttccctcttgattcatgcttaaattgtacctctttatctagtttcctaagttattaattttacatatttattattactgttttttttttgagacagagtctcactctgtcacccaggctggagtgcagtggcgcgatctcagctcactgcaacctccgcttcctaggtttaagcaattcttgtgccttagcctcctaaatagctgtgactacaggcatgcatcaccatgcccaggtaatttcttttgtatttttagcagagacagggttttgccatgttggccaggctggtctcaaacttctgacctcaaatgatctgcctgctttggcctcccaaagtgctgagattacatatgtgagccaccgtgcctagctttgaatttctaatatatgcatttaatgccataaatttcccctttaccactcctttcactgtatcccacaaattgtgataaattatagtttattttcctttagttcaaaatatttttaaatttctttttcctattattttattttattttattttattttattttatttttttagacagggtcttgctctgacactccacaggctggagtacagtggtgcgatcatagctcactgcagccttgacctcctgggctcaagcagtcctcctgtctcagcctcccaaagtactgggactacaggtgcatgccaccccacctggcttaaatttctcttgaaaattcttctttgactcggctgggtgcagtggctcatgcctgtaatcccagcactttgggaggccgaggtatgtggatcacgaggtcaggagatcaagatcatcctggtcaacatagtgaaaccccgtctctactaataatacaaaaattagctgggtgtggtggcacctgcctgtaatcccagctactcaggaggctgaggcaggagaatctattgaaccaaggagttggaggatgcagtgaaccgagattgcgccactgcactccagcctggtgacagagcgagactccatctcaaaaaaaaaaaagaaaaaagaaaattcatctttggctcatgtgttatttagaagtgtcttgtttaatttccatattaaatacttgggggatttcccagctatctttccattattgatttctactttatttcaactgtggtctgagaacatactttatacaatatctattcttttaaatttgttgaggtgtgttttatggccccagaatttgatgtatcttgttgaatattccatacaagcttgagaagaacctgtattttgctgttgttgcatagtcttctataaatgtcaattagatcaagctcattgaaattgctattcaggttaactttagcctttattttacacctgcttcatcaatcagctactgatagacaggtgctgaagtctccaactataatggtggatgtgcctatttttaagttctattaatttttgcacatatatttatttaggtgcatataagtttaatattgttatgtcttcttagagaattgagccaattatttttacatagtgctcttatttatccctcataagtttccttgttctgaaatctgctttgtctgaaattaatataactgctccagttttctttcaattagtgttagcatggcatattttctctatttctttgcttttaacccatcagagtcttaatatttaaagggggccgggcacagtggctcacacctgtaatcctagcactttgggaggctgagggaggcagatcacgaggtcaggagatcgagaccatcctggctaacatggtgaaaccctgtctctactaaaaatacaaaaaattagcgaggcgtggtggcaggtgcctgtagtcccagctactcaggaggctgaggcaggagaatggcatgaacctgggaggaggagtttgcagtgagctgagatcacgccactgcactccagcctccagcctgggcaacagagtgagactctgtctcaaaaaaaaaaaaaaaaaaatatatatatatatatatatatatttaaagggtttcttacagaaaacaaaaagctaggtgttcattctacttctttaatccactctgaaaatttctgtcttttaattgtgtgtttagatcagcagtacccaacctttttggcaccaggaactggttttgtggaagataatttttcaatggaccaagggttgagggagatggtttggggatgaaactgttccaccttagatcaccaggctttagttagattctcataaggagtgcacaacctagatcccttgcatttgtagttcacaataagcttcaaactcctataagaatctaatgccaccgctgacctgatagaaggtggagttcaggcagtaatgcttgctcacccgctgctcacctcctgctgtgcagcccagttcctaacaggccttggaccagtccacagcccagttcctatcaggaactgataggcctttgggaggtgattaggtcatgaaggtaggacttggtactgagaagtggagggggctgccataataaatacctaaaatgtggatgcagctttggagccaggtaatgggtagaggctggaagaattttaaggtacatgctagaaaaagcctacgttgctgtgagtggttcataagcggaaattctgaggaggaatctcaggagaagaggagtgctacagagacagactcaatcttctgagaatatctaagtggttatgagctgcatattggtagaaatacggacaataaaggccattctgatgagtttcagacagaaatgaggaacatgttattgttggacaatggaggagaggccattttatcataaagtagcaaagaatctggttgaattgtgctcatgccctcgtgttttgtggaaagtcgaacttgcaagcaatgaaactgggtatttggctgaggaaatcactaagcaaagtagtgaaaaggtaggctggttcctctcaattgcttaaagtaaaatgcaaaacgaagaaataatttaaaagatgaaattgtttgtcaaaaggggaagcagaacttaaagatttggaaaattctcagccaatccatattggaaataacaaaaaagcctgttcaagacaccttatgataaagagattactatggatcaggcatctcaccagaagcctcatgctatacatcaaaataatggggagattcatcagtcatctaaacagaaaacaggacctaaaatctaagacaatggatgaatacccgcaaagacatttcagagatcatcagggctgcccctcccatcacagggcttcaaaggagggaccaccactacccagcagcctcacactgcaggctgtgctctttgctctccatcaccacactctccagtcatcccatgtgtgctttggtgggccccattgcagcatgcactgcaccaagcaaagctgtggggggcagagccggatttcaaaggatgccctagagagcactggggcccaggcagagaaccaccacaggggcagggccactgcagagagctcccaactaggaaaatatccagagagcaatgagggcttgacctcagactggtagagccactaccatgcaattccaggcccaggagagcaacaggtccacaactccaacccataagagctgtggcatgggctgtacacagcaaagccatgggggtggggctgtccaaagccatgagggcagacaaagctgaggaggagagatcaccatcccagtaggtccagaaggctgtcttccaccccagtgggtggcatcaggtcaaggaatatttctcttgagccttaagagtttggacttgttgagacctctcatacctttctttattcttatttctcccttttgggatgggactgcctgtcctgtaactgtcccaccattgtattttggaagcaagtagcatgtttgattttaaatattcaatttggattgctggagaacaatgccttaaaatgaatcataccttgaatctcatccacatcctatttagatgacatttagataaaactttggtcttgagactttcgagttgatgctagaatgagttaagacttccaggtctgttgggatgagattaatgtatttcacacctaagaaggacatgaattttggaaggccagggtggaatgctgtggtttgcatatatattttgtatacagacaatttatcagatagacgtcttgaaaatattttatttcagtctgtttctccctcaaattcatatgttgaaatcctaacccctgaaatgatggtatttgggattggggtcttttggggtgattaggtcatgaaagtggagccctcatacatgggattaatccccctataaaagaggcctgagggagaccccctgtcccttccaccatgtgaggacatcacaagaaggcaccatctatgaaccaggaaagggttcttcacctgacaccaactctgctggcaacttgattttggacttcacagcctccaaaactgggagaaagaagtttatgttgtttataaactacataatctatggtattttgtcagcagccgaaatggactaagaaagcaggtctgctggtgataaagccccctagtttttatttttctgagaaagtctttgtctttcacttgaacaataagttcactggatatagaaatctaggttgttggaattttttttctgtcaacaccttaaatatttcaccctactactaactgggtgggtagagtgggttttaatctccgcaaaatgccccatcccagaggaattatcactatttgtgttgtctggtagttccctaaaaagctgcatgctcaaggcttgcctttatttgacctgactcagagctcactgtgtataaacagctctatacctaaggtgtttattgaaaaaatgagaaatttttctacactgtagctgcctgagataacaataagagctgtggctaacaaaggctaactaaaaacctttaaagtataaaccaaagataaaatcctaagcccccaactgactgaatgaaccccatcttggccaaagggaacacagagaaacctgaaaaactaaattccaggccatgacgggaagggaggttagatttgcctcgttatactcctgcctttttggagtttaggcacaggtgaccagcattaacattaaaactgagatcataagactgaccaaacagactctttgtggcaataagataccaaattgcaacccgactttggtatagtatcacatgacggatagcagactctgaaggaaataaaaatattttatcccaaaatatatttctttgacatattttgaaatggctgccacaagccagcagattgatgtagaggaaatttgcatctgaagagaatctccattaatgcagccaggccttccctttctaggcctttcctagatctaggagagaatgagagtctgacacctttaaaagtttaaaaagaaacatttactatctattctctctgagggctgccacctaagaggcttcatctacataataaaaaccttgttgttcacaacctccttatcttaactcaggcattcctttctgatttcaagcctttagacaacagcttaactctctcaaccaattgtcaactaaagaatccttaaaacccacctaggacttgcaagccctcactttgaaatgtcccggcttttcgggctgaaccaatgggtactttacatgtatttatttatgtctttactgtaacttctgcatccctaaaaggcataaaaccaaaatgaaacctgattgcctcaggcacacttctcagaacctcttgagactgttccctggaccagggtccctcatattagcccagaataaacctctttaaatattttacagaggttagtttatgttcatcaacaaaaggaaaaactgaaaaatgagatatccataatgggcttagaaaagtgatgacatattcctacaaatctaaacaccacatgcaagtgcagggctgtgtacatgctcaggaaaaaacctgataaagatctagtctctcacttatagcttaacttgaggttctgcatttgcaggaagtgaaagttaaggcagatgtataaactgcaggcctgaacattgacagtgtgctccaacatatacacagagttcccagcaaagactgggagactcattggtccaagacattcaaggaaatttctgtccaatcattagctgaccactataccaactaagaagagacttcggtggctgcacataaccaagaatacagactttacagaattaacccaggaaatccaccaaacaaacaagcagaagcaacaataacaacaacaataaacaaacaaaaaagcttggttaggaaggggaatcttattttccatgtcgccacattatattatttaatatattcagttttcaacaagaaaacataggagataggcaaagaaacaggaaagtatggcccatacacaggaaaaaagtcagtcaatagaactgttcctaaggaagagcagatgagatgttggacttactagacaaagactttacatcagctattgtaaatatgtgcaaagaactaatgaaaatcttgtataaataattaaaagaaagtatgacaacgacatctcaccaagtagatatataaataaaaacatagaaactacaataaaaacaaatagaaattctagaattgaaaagtacataattaaaattaaaaatcactggaggggctcaacacaagattttcacttacataaaacagcatcagtgaaccggaaaatagatgaaataaaatgatacatttgtagaataggacaaaaaattaatgaaataaatgaacagaagcctcagaaatctgtggaacaacatcaagtgtgccaacatacagacaatgtgagttaaggaggataggagagagaaggggtcagagagaatatatggagaaataatggctgaaaatgtgccaaattttatgaaaacattaatctatgtatctaagaagcttaatgaactcctagtaggataaactgaaagtgatccacacctagatccttcataatcaaattgtcaaagtgacaaagacaagaagagccttgaaagtagcaagagaggctagacacagtggctcacgcctataatctcagcactttgggaggctgaggcaggaggattacttgagcccagaagttggagaccagcctaggcaacataatgagtctccgtctctacaaaaattagccaggtgtggtggtacatgcctgtgagccctgctatcaggaggctgatatgggggaatcgcttaagcccaggagattgaggctgcagtgagccattatcatgccaccgcactctagcctgggcaacagagcaagaccctgtctcagaaaaaagaagaaagtagcaagagacaagcaactcatcacgtgcaagggattctcaacaggattaatagctgagttctcatcaaatatcatgggagccagaaagcagtggaatgacatattcaaagtgctaaaaaaaatgacttttaactaagaattctatatttggccaaactgtttttcaaaaagagcaagaaattaagacattcctggataaacaaaaattggcagaattcattattagcagattttcacataatggctcaaacaaatactaatgggagtgctttagctgaaatgaaaggacaccggacaataactagattcacataaggaaataaaagtcaccaattaaggtatctacaatgtaaataaaaatgacaatttgttttgtgacacttttcttctcctatctgatttaaaagacaactacacaaagcaataattgtgttgatgagtttaaaatgtataaagatgtaatgtcatgacaatggcaaaaagaagagataaggaatagatttatattgaagcaaagttctttgtatagtattgaaataaaattcatattaatatcaactatactgttttaattaatatgttattgtagccctcagaggcccactaagaaaataaccatatatatatatatatatatatatatatatatatatatatatatataaaacagacataaatccatttttcccaggaattacattaaatgaattaaacactccaaccaaaagtcagagattggcagaatggatttgaagagtgtgattcaactatacttcaacaagacacatacttcagattccaatacacaaataggttgaaatgaaaggacggaaaggatatgccatgcatacggtaaacaaaacagagctggtgtggctacaccaatatacaagataggccttaaggcaaaaattgttactagagacaaagaaatacttgtataatgataaaagagtctacctattagaaagacataaccaaagtggttatgtcttgccatctaacaacagagctactagatatatgaagataaaagtgaaagaaaggaggaagaaatagttcaacataatagcaggagacttaaatactcaactttcaataatggatagaacaactacacagaagaccaacaggggacccaaagacttgaacaacactctaaaccattagacataacaaacgtctatagcacactccaccgtaccacagcagaatacatattcttctcaagtgtacataggacattctctaggatagatcatatattagataaaaaaataaatctcaataaaattttaaagattaaactcatataaagtatcttctctgaccacaatagaactagaaattaataacagaaggaaaactggaaaattcacaaatatgtggaaaataaacaatgcacttctaaaaacaaccaaggggtcaaagaacaaatcaagagaaaaattagcaaatactttgcaatgaatgaaaatgagaaagtatgtgatatggtttggctgtgtctccattcaaatctcaacttcaattgtatctcccaaaattcccacatgttgtgggagggacccagggggaggtaattgaataacgggggctggtctttcctgtgctattcttgtgatagttaataagtctcacgagatctgatggttttatcagggtttacccttttgcttcctctgcattctctttcctgctgccgccgtgtaagaagtgccttttgccctctgccatgactatgagacctctccagccatagagaactgtaactcaaattaaacttcctttttttctcagtcttgggtatgtctttatcagcagcatgaaaacagactaatacagtacaaaaacaaaaaattgtttcatttaaaagataatcagaattgcaaacctttagctagactgaccaagaaaaaagaagattcaaattactaaaatcagaaatgaaagagacataaacatgcatatatctttatattattataaagaattatttatatattatcctaaattattacttatattcctttaggtatatacccagtaataggattgctgggtcaaatggtatttctggttctaggtcgttgaggaatcttccacaatggttgaactaatttacattcccaccaacagtgtaaaagcattcctatttctccacagccttgccagcatctgttgtttcttgactttttaataatcaccattctgactggtgtgagatggtatcccactgtggttttgatttgcatttctgtaatgatcagtgatgtagagctttttttcatatatttgttggctgaataaatgtcttcttttgagaagtgtctgttcatgtccttcacccactttttaatgagagtgttcattttttcttgtaaatttgtttaagttccttgtagattctggatattagacctttgtcagatagatagattgcaaaaattttctcccattctgtagggtgtctgttcattctgatgatagtttcttttgctgttagttcctctttcttttagatcccatttgtcaatttttgcttttgttgcaatttcttttgacattttcatcatgaaatctttgctcatacctatgtcttgaatgggcctagattttcttctagggtttttatagttttgagttttacatttaagtctttaggccatcttgagttaatttttgtataaggtgtaaagaagggctccagtctcaattttctgcatatggccagccagttttcccagaaccatttattaaatagggaatccttttcccattgcttgtttttgtcaggtttatcaaggatcagatggttgtagatgtgcagtcttatttctgaggtctctattctgttccattgggctatgtgtctgtttttgtaccagtaccatgctgtttttggttactgtagccttatagtatagtttcaagttgggtagcataatgcctccatgttcattctttttgcttaggattgtcttggctatacgggctcttttttggtcccatatgaattttaaagtagtttttttctaattctgtgaagaatgtcaatggtagtttaatgggaatagcattgaatctataaattattttgggcactatggccattttaacaatattgattcttcctatccatgagcatggaatgcttttccatttgtgtcctctctgatttccttaaggggtggtttgtagttttccttgaagaggtccttcacttcccttgttagctgtattcctaggtattttattctctttgtagcaattgtgaatgtgagttcattcactatttgactctgcttgtttattgttggtatataggaatgcttgttatttttgcatgtttattttgctgaaggtactttttgttgctgaagctacttagcttaagaagctttgggctgagacaatgggattttctagatatgggatcatgtcaactgcaaacagacccagtttgacttcctctcttcctacttgaatacctttatttctttatcttgcctgattaccctggccagaacttccaatactgtgttgaatggaaatggtgagagagggcatccttgacttgtgccagttttcaagggaatgcttccagcttttgcccattcagtatgatactggctgtgggtttgtcataaatggctcttattattttgaggtatgtcccatcaatacctagttcattgagagtttttaacatgaagcgatgttgaattttatcgaagccctttcccacagataaccatgtggtttttatctttagttctgcttatgtgatgaattatgtttattgatttgcatatattgaactagccttgaatcccggggatgaagctgacttgattgttgttgataagctttttgatgtgctgctggattcagtttgccagtattttattgaggatttttgcttcaatgttcattggagacaatatgttttataaaatagacataaaaatactagcaaaccaaatcaagcaatgtataaaaaggattatatatcataagcaagtggatttatccaggaataaaagattggcataacatccaaatataatcagtgtgaaacaatatttttttttgtaatagacaaaaaaagcatctgataaaatacaacacctttttctgttaaaaaaaaaaaaaaaactcaacaaacttaaaatagaagagaatttccttaaccttctacagggcatccgtgaaaaacccaaagctaacaccataacgtggtaaaagactgaatactttcccactaagataaggaataagacaaagatgtctgctttcaccacttctatttaacactatactggaggttctagccagggaactattaaaaggcatgcagactggaaaggcagaagtaaaactatctctacagatgacataatcttgtatacagaacatcctaaggaatccacaggaaaattattagagctaatacatgcattcaacaaggttgtgggatacaaaatcattagagaaaaattcatagtatttcaatactttgaatgaacaatttgaaaatgaaattaaaggccagccacagtggcttgtgcctgcaatcctagcactttgagaggccagagcaggaggatcgcttgagcccacgagttcaacaccagcctgggtaacatagggagactccgtcttctctacaaaaaaaaaaaaaaaaaaaaaaaaaaagccgggcatggtggtgcatgtctgtggtcccagctattcgggaggctgacatgggagcatcgcttaagcccaggagatcaagactacagtgagctgtgatcacaccactgcattgcagcctgggcaacagagtgaaactctgtcaaaataaaggaaagagaaagggaaagggaaagggaggaaaaggaaggaaggaaggggaggggaggggaggggagggagggagggaggtaggaaggaaggaaggaaggaaggaaggaaggaaggaaggaaggaaggaaggaaaaagaaaagaaaaagaaaaaattccatttacaatagtattaaaattttaacaaataatttgcaagacttgttcactgaaaactacaaagcatttctggaaggaattagagagcatctaaataaagtaaggcatcccgtatttatgacttggaagatttaatgtttctaagatgacaatactctctaaattaatctacagatttgatatcctaaaaaataaaaccagatttttgtttttcatttttataatttgtttgtttttacttttttgctgatctgatgttaaaattcatatgaaaatacaggagattcagaatagctaaaacaatcttgaacaaaaagaacaaacttagagaactcgtatttcttgatttcaaaacttaccacatttggttatatttggtacaataatcaaaacactgtggtactggcatgaggataagtcaatagttcaatagaatagaattgagagcacagaaataagtgcttacatttatagtcaataagttttctacaagggtgccaagatgattcaatgaggaaaaaaaagtaacattttagatctttccctcacatcaaccatatacaaaaattaactcaaaatggatcacgaacttaaatgtaagtgctaaaactacaaaactctttttttttttttctgagatggagtttcattcttgttgcccagctggagtgcaatgacacgatctcggctcaccacaacctccgcctcccaggtacaagtgattctccagcctcagcttcctgagtagctgggattacagacacgtgccactacgccctgctaatcttttttgtatttttagtagagacagggtttctccatgttggtcaggctggtcttgaactcccgacctcaggtgatccacctgccttggctccccaaagtgctgggattataggagtgagccactgcacctggcctataaaactcttttttaaaaaacacgggagtaaatcttcataatcttgaattaggcactggtggctttttggtttttttgttttttgttttttgttattttttgataaagtctttctctgttgcccaggctggagtgcagtggcgcaatcttggctcactgcaacctccacctaccgtcccgagtagctgaaattacaggcccgtgccagcacactcgggtaatttttgtatttttagtagagacggggtttcaccattttggccaggctggtctcaaactcctgacctcaagccatccaccagcctcagcctcccaaagtgctgggattacaggcatgagttactgcacccagcgttgaattaggcaatggtttcttaaatatgacatctaaggcaaaagtgacaaaaggaaaaataattgataattggattttctcatttcctcaaaattaaattttcagggggttcaaaggacaccatcaaaaaagtgaaaagacaaccccacaggatggggacaatatttgcaagtcatatatctgataaagaactctcaaaactcaatagtaaaaagataatccaatttagaaatgggcaaaggactcattttttcaaagaaatttttccaaaatttttccaaagaagatatacacgataagcatgtgaaaagatgctcaccatcatttgtcaccagggaaatgcaaagctaaagcataggagatactgctgcccattcacgaagatggctagaatcaaaagcagccaacaacaaggcttggcaaaggtgtggagggatccgaatcctctcacggtgggaatggatgatggggccactgctttggagaagagcatggcatttcctcagaaggttagcgtaggtgccacgtgatccaccaattccaatcctaggtatcgtttttgtttgtttttttgggatggagtcttactctgtcacccaggctgaagtgctggagtgctggagtgcggtagaatgatctcagctcactgcaactgcaacctccgcctcccaggttcaagcgattctcctgcctcagcctcccaagtagctgggactacaggcatatgccaccacgcccagctactttttgtatttttagtagagacagggtttcaccatgttagtcaggctggtctcgaacccctgacctcagataatctgcttgcctcagccttcctaagttctgggattacaggtgtgagccaccaagccccaccctaggtatctattcatatctaagagagctgaaatatatttctacataaacacttgtccatggatgttcatcagcagcactgcttacaatcacccaaaagtggaaactgcccagtgtccatcagctgagggcatttatctgaggggagttttcgggaggcgggaggtgagaccgcatgggaggaaagctcagggcctggagtgcattcagcagtggctgggaagactgcctcagggcctgtgtgctccctgctgcactcacaccccttgctccatggagaactgagatgaaaccttgaagattccaaatgcagttgatggaaatggcagttgctgtggttattatctagggagtgcctgtgagaatctaacaagaaaacacacttagagagccccaccagcctcgcggaacaggaagcctgcgttctgtgtttccagttccctcattgccctgtcctgtcctgccctccttcccactcactggctacacataatcaccactggtatcacaggaggtcttggatctgtgtgtgtgagagagacagacagacatagacagacagacagagtcagtgggagccagagagagaaagcatgggagctaatttctccctggctcccaatgaggaatgaggacaggaaaagtcatgcagcatccaggctccttggcgcaactgggtcccaattcccatcctcctgccatcagcctcggtctgtccccaccttgccactgcccccgaattaaatgcttccgagcattttctggaactgtttttctcacatcgcccacacattcttattcccttagtcgaggctctgtccaccttcagcccaccggacagtcaattttcccagccgctggtgagtttctggtttgccaagacccagaggctgggggaagccagacagcaggtggcagctcttccggccgaggagaggagagggacagggctggctcctctagatgaagaggtgagagagctgtgctaggatcaggcggacagtgttcctggcagtagcagcagcaagagcacaggccctgaggtggggctgagctgacctaccccaagagtgaatggcaacccctcaggggccttagagagtgagaaggggtggagagaagtggaggagggtcgccaggggccaggtcatgccaggcctcatggggtctggtggcagcttccagctctattttggttgcaggttttaatcccaaaagttgtgttccctggtcacacttgagaaacgtgggcagctgctatgttgaatggaggttgaaaagaaggggcattaggggggtttgctgtggttgaagtggggatgaccacatgggctaggcgttggagggggcaggctggagagacgcgggaagactgggtgcatgaaatgatgtcccctgcccaggactcgctgaggccacggcaagtgcatgaggaagcacagagtccagggacttctggtctccagcctgagcaggaggtagacaggatgtgaatcccagtgtggggatggatggggcccagtggaacccttgccaggtgggccctgaagctcagggccctctcaggaatcattttatgtacatcatggtgcaggcagggtagtgctgtcctggggcaatgtgaatccattatttattgtggcacagcagtattgtcattttcttgtttgtttgcttagttattgtttatccttgaaatagaattaatggcttgctgaagtatcctttgtgcctagaacaatgctggcacagggcaggggctcaactgatatttattgcatggatggataaatggatgaatggatggatgatggattattggtggatagatggtgtattagtcagggttctctagagggacagaactaatatatataaaggggagtttattaagtattaactcacatgatcacaaggtcccacaataggctgtctgcaagctaaggagtaaggagagccagtccaagtcccaaaactgaaaaaaattggagtctgatgttcaagggcaggaagcatccagcatgggagaaagatgtagtctgggagactagacctttctcctcttttcacacttttctggcagcttttcatattctagccatgctggcaactgatcagatggtacccaaccagattaagggtgggtctgcctttcccagcccactgacccaaatgttaatctcctttggcaacaccctcacagacacacccaggatcaatactttggatccttcaatccaatcaagttgacactcagtattaaccatcacagacggattgatggatgaatggatgaatggataaatggatggatgatggatgggtggatgggtggatggatggatggatgaatgaatagacatggaagaaaaggaaaatagatgcacagatggacagatggataaatacaaaaatagatggacagatggatgatggatggatggttggtgttaaggacttaattgtgtccccccaaattcatactgaagcactaatacctaatgtggctgtatttggagatagagcttttaggaaggcaattaaggttaaaggaggtcctaagggtagggccctgattcaatgggactggtgtccttacaagaagaggaagagacactagagagctctctctccatgtgtgcacagaggaaaggccccgtgaggacacaaggagaggagcctcctacaagctggcaagagaggcctcaccagaaaccagccctgctggcaccttgaccttggattgagtgtgagaaactcaatgtatattgtttaagccacccagtctgtaatattttgtgatgatggcctgacatggatgatatggatggatggagggatggacggctcccccagcccctctgagtcttccctctgggtgcaggcaaccctattcagggacaatgtgagtgcatggctgctgctggaaagaccagtcttgggaactggggttatgtttgacttcctggctcttcagcttgatgctctctagtcccaatctgggacagggctcctttcccacaatgttcaagtttgcagagggaccctggaaaccctgaaggcaatgccttggggccctcacacctggacccattcacacatttccaggtattggtgcctcccccgggagcctgcccagagcccttgcggaggacctggggcaagggaacagggcgggaagctggggcaagggaacagggcaggaagctgagagccgttttcctccgagctaatggaacctcttccatcaccaccagcttagcctttaatcatcctcactttcaagtggaaggcagagctccccagacactggacgggtcagggccatcatcttccaactaggggtgcacagcagggctaatggacgggactggggccaacagctggaaatcaaatcatctcccagaaccacagctcagcagaccctgggggaggggcacctccactctctgcgtagctcttgggtgcaggctggcaaggctggggaacagtcctgaactgctccacccaggcgttaccccctgcacacttcttggcctcaaaactttcgttatatggaagcttgatgagtaaaagttggtctggttgacagcaggtaagggctttctccctttctgccaggctgaccctgggaagacaccaaatggcatattggaatggtccgcttccaccctccccaacctgcctacagtgaccatagctgtgggcggccaccatcctgcccagaccacactgacgacgcttctcacagcctcccctctgacccctcctcctccacctgcccctggcacctgctgtggccctgccaccactcccactgcagtcccagcagaatgaagaggcttgttcaatgtgtggtttcaaggagtgaagtgcaaagcttcccctttcctttgcagtctctcttgatgtgttgtggtggttatgtttgctatttaatggcattctagtcaagaaaagttgaaattataaattatagaaaaaaattaaaattttaattttaatggtaaaataaaatttaccattcatctttatatcattcaatgccaattttaaacataaattgctgtgtaagagcatttaactcatgcagaaacaccaaaatttctgtaactcgtacatgcatgtatatgttgtccttttcagaaaagcgcaaacacttcactgaactaactcacctgattgaatttcacttcctggtgcaggcgcattgtaccaaccctctctacttcagcctaccaggagggaggaaggccaccgtctttccttctccttccatgtcatcctcagcgtcggtgcttgtgcagtacaggtaggtgacagagccggcaaggatgcccagggctgctcctctgtgtttcttaggagcccgctgccccaccgtgctcaggcagggcagcacgtgttggccacgctcaccagctggctgagctccacccggaaccctgtgctggggccttgggaggcctgatggggatgggctcacactcatccacacatcccttctgctcagagggcccagggcttcatttagcacaagttcagacatgaaaccgttaagaattccagcgtagccgcagcccagcactgaacccaatgcctgctcctctgactgtctaccttggctggttcctgtgtcactggaaggaggaaggaacccctcccccgtcaccacggttgttctgttttggggcctggcaccatcacccaacaactatttgctgaataaacgcattgttcacccactgagtatttgctgagcacctactggcagggcgccctgagggcgcagagatacagctgaggacagcgcagcttctaaccttgccatccccaaggtgcgcggagccctcagggtgacccagcttgctgacgagcaagcggaggccgagcaggtgagactggctgagtcagacctgctgccggggcagacgcaggacaaggctgcttttttgcccctggacctcaggatccaggtccgggacgccgcgggcaggggctctggaccgcgctactcgacccctcccccaccgcctgggtctgccaggcaggagggagccgctgcagccaacctgctcctcccgcactatcgattttcaattgacctccgcctcccactttacacttcagagcgctcagcggcctccacacctcctgagcaaggaggaaagccagctgggcgcggggcccctgcttcctccccgagggagtcctcggccaggccaccaccaccaatctcgctcctctccctttcctctctgtaaatgacacgaatggcattgtaaggactataacaggcacttggcctttctaactttttatttgaaaataacatcacacctacagaggagttgcaagaacaggacaatggattcccgtgggccctgtacttaggttcgcccattgttaacaagacaaggactttctctttcgggacacagcatcataatcaaaatcaggaaatttaaccatgatgcagtactcttttctaatattcagtccatattcaaatttcatcattgtcccaaccccgtgtgtccttcagagctcttatttttccctaatgcaggatccgactccagatcacacatctcatttccttatactgtctcttcattcagaacagttcagagagtcatagcatatgattctgacaggcgcagtgccctgctgtcatgctccccacacgcgtgcctgttcatgcacatacaacacatgcacgcgtgcatgtgcacacatacatatgcatacatatgtgcacacacatgtccatacacatccagcctacagcgggcactcgaggtcccctgccatcctccagtacctccccagccctgtggccatcaccttctctgcacacagcaccccaccaagctgccacaatgcctgtgttgggctttctctgagtggcctccctctgggtcagggcccagtcccctgggccaaattatgcccatccaggctggccttgtgcccagctggcttgtcctggccaaacctgctccaggggcacctctagagctgaggcccgggcctgagggcagtcccccagacctatcgggaggcatgtgaagctgccagcacagcaggaaagtggctgagctcagtgactctgggactctccgtgtgacctcaggcagtttctctgctctgtaagccacaactctctctatctggaaaatgggaagaacattattatatgaacactaaatgctcagaaagcccttccttcctggaatgggttagtggtacagcactgccctatcccttcttcccttttgagaagcacagaaccctatgggtgctgtccccagggcactcaggcccccactgctccttggtgccatctgaggccaggaatcagctcaggctctggcaaaaggattcttgtttttcgttcaagcgccacctcttcctctgcagacactcctctgcagtcctgcatgtactgcacgcatgcacacatgcatgtgcagtggtcccagaaggcagccccaaatctacaggctccacaaccccagggctcagagcctggcctagcacagagcgactcacaggccacctggggccatggaaggccaggacctggcaccctccttggcagcagaaaggacagagaaggtgccagttggaggcatggcccgacacagcgacactgcctagttcaagtcacaggccctgcaggaagagtgcagggcttggatccactcatagtgctgttccaatgacctgtggggtctgagtgccccagaagtctcaaacaccaatgcttgggtctatacattcagacaagccagactccatgggtctgacccccaggcagcctcccgtgccaccttcccctggatcaggcgcaccatccacaccttgtctggcttcactcaggcctttctcagtgctaacccacgtggctgttggtttgctgcttaggtgtgtgagacagtaacatgcatcttctcccagagctcacagcctgctggctttatctggtagcacatctgctagtgctccactgacctgtctatttttcctacctcattagggcaactttgtttttctgaaggtgattatgactacttactgaacttgaatatactaacagatacttctcaagtatacgtctgaagacgctgctctgagatgcacaggagtgtagatgagacgctgtctgagatcagagtttacttcttgcaaggccatcagaggagaggacgtcatggaggatgtggtcatgggtagtgcctctggctccggacaggcacagtgtgcagaggaccttgcaggagcatgggtatgaagggaataatgagcgagggtaagccaagaaatgttctagggggcagagccagccaggggccaagccaggacagttggatgcagctagacccagcagggcctccgcccgggttggactctggtagcatccactgcagtctccatccagccacgtgctggggtcacaaggcatgaacatgatctcacgatgaaagctgtctgtctgtgactgtgggagtgattgcattcccatcctttcaagctttccccagcaggagtggcaacgctgagcctcactccctggggcctactgtgacagacgccatggccagctcctcagggtggaggtgagggtgagggatgcagaccccacaaagttcaacccagcctactcttcactgcagctctgacttgcagatgtcaatgggctccttggaattcttcaaattcagagtcacagcccatttgagggggcagcctgaagctggttcgctggaacctttttctgtccacgttgagtgcttgctagaagctatgagagcagctccttctcactgttgtgatggcacaaaccacagccttaacccctgtgtccgcctaggctggagttgggctccttgacccctccctctccctcacactccatacaattaagccccattcactttactcccataatccctctaatgagcaggctcttcacccacctcctgccccctcactgtgctgcccagtttaggccctcatgagccctcacattgattccctgcctccagtctcaccctctgcaatttcctcccaacttaagtgcaaaacagaagtggcatcatggcaatcttcagtctgaaatatctaatgggcattcaggtaacagaatacttgagcatgggcatccaactgcctctcccaaatgctagcccaaatgacttcagaaatagaaaaggaaggagaaacctgtatccattttggaaatccatcagggcaccatttacacgccacacgcagagccatttccataagttacagtgcaggcaaaaaacagcctgaaggaaacttgcaaccctccttgctgagcaagtacaggcatgggggaagaaactgcaggggcctgagaaaggcccaggaataacccagctatagaggatggtgcagatgatgagggcatgacatatggaacctcttagcactgagggtcagcatgtctcaaaagcagaccagggcaggggggccagggcaatacttttcctgaggggtgcgcagtagtccaggaaacaggctagacagacaagggatggaccagtccaagtagaaaattaataagaaaaataggttcaaggaagaaattcccctgtacagagaaaaaacaccctgttggaactgaccagaaccatctcctccatcttgggctctgagttgattgtgaggcccttaggcccttagcagaggattctgttgttatttgtgtggacagcaaggagaagcaatgatgtaaagaaatgccatacttgtttgaggcaaatgccagtctttcatagagaccttgcaattcaatgctaggtcaatggaaacagcagatatgagaaagagaaaggctttgcaaagaaaaataaaaacacacacttctcaaaagatagatgaagagtgatgaaaatgatttaccaaaggaaacagaaattgtcttagtccatttgtgctgttataacaacatcatggcctgggtaatttataaagaacagaattttttcacagttctggaggctgggaagtccaagctcaaggcatcagcaggtttggctgtctggtaagggctgttctctgcttctaagatggcttcttgagtgctgtgtcttcacatggcagaaggccgaagagcaaaaagggtgaaatccttccatcaagctctttttttttatttttaagttttataggtacataataggtgtatatacatagtagctatatatatttatgggttcaatgagatattttgatataggcatgcaatatgtaataatcatatcaaggggtaaatagagtatccatcacctcaagcatttatcctttgtgttttaaacaatccaattatactattttggtctgtcaagccctcttataagagcatttaatcccactcatgagggcagagcccttatgactgaatcacctcccaatactatggcattggggatttaattttaatatgaattgtggagaggacacaatcatttaaaccacagcagaaataaatctcagaaaccatccatttgacgttcccaataaaatataaatttaaaaatagctcttaggagtagtgacattgccaaaacggcagagtaggaagctccaagccttcattcccccatagaaacaccaaaaaacagccagaaactgggtatttaaaactttataggcactttggagagcagaaaaaggtccacaatagccatattcacaagagtaggaagttttctggcatttttacacactcttgcctcactcccttcttggcacagcacagccttggtctgcaggaggccacagcccaattctcagtttcctccatcaaactggagggagcagaacggatcttagttgcgatgttctttttttttttttttttttttttgaaacagagtctctctctgtagcccaggctggagtgcagtggtgcaatctcggctcacggcaagctccacctcccaggttcacgccatcctcctgcctcagcctcccgagtagttgggactacaggcgcccgccaccatgcccagctaattttttttttttgtatttttagtagagatggggtttcaccgtgttagccaggatggtctcaatgtcctgacgttgtgatccgcctgctttggccttccaaagtgctgggattacaggcatgagccgccacgcccggcctagttgcaatgttctaacctgtgtaggggctgcctgaagaactgctctcttccatgcctaaatcacatctcaggcagggaaaagtggcaaaactcaggactcaagcagggaaaaaacaatgggcattgcccataaaggtttcatggggactacagacccatagacacctggggtaaaagattacaggtggagacatacaatagaacatctaaggtcccaaggaaaactagggtgagactctttggaaaattaagacattcaaaagccactgtgtatatagacaaaattgggggtgggggtgcagaagcacacacacaggcacaggcaagatgcatgcttaaaaaatacctgagaaactttcacatctggctgatcttaagtctcagagcacacccagcaaagcaggaaatgattgccctggtaaagagtcagtctgaaaagacagaaagaggtgactgctttccaaatgcccaattttcaacaataaaaaattataaggcatacaaagaaacaagaaaacatagctcattcgaaggaacaaaataaaatggcagaaactgtctctgaagaaacatgggcattgcacatactagacaaataattcaaaacaattctataaatatcctcaaagagctaaagaaaacacagataaagaaatgaaaagaatccagaaatttatatagaatcaaaatgataatattaacaaaaagatagaaatgataaagaaccaaacagaaattctagagctgaaaaatgcaataatgaattggaaaattcactagaggggttcaacagcaaacttaaacaggtagggacttgaagacaggtcacttaacactagtctgaggagcaaaaaggaaaaagaacgaagaaaagtaaacagagcctaagagatttataggacaccataaagccaaccaatatatgcataataggagtctcagaatgaggagagagggaaaagggtaaaagagtttacttgaaaaagtaacagccaaaaacttgccaaacttttatatccaaagaaattgatataaaaatacaagaagttcaacaaattccattaggataagcccaaacaagcccacagaaagacacactataatcaagccacattataatcaaacctttgaaagacaatgtcaaagggatagtcttgaaagcatcaagagaaaagtgactcaccaaatacaagagagccacagtaagattagcaatgattttcctagaagaagccctgcagaccagaaagcaatgcagtgatatatttaaagtgctgaaagaaagaaaaagctgtcaactgaacattctatacctagcacaactgtccttttaaaatgaggaagaaattaagatattctcagataaacaaaagctgagggagctcgttaccactagacttaccctacaaaaaatattaaaaggaattatttaagttgaaattaaaggatgctaaatagtaactcaaagccatacaaaaatataaagttatgcaataaagctaaatacatagacaaatataaaaaccagtattattatcattttggtttgtaatgccacattttattattttatagagtttataagacaaaggcatataaaataattatggatctatgttaatgggaacatatataaagatgtaatttgcgacatacctcaataacataaaatgggaagagccagaaggttgtagagcttttatattcaattgaagttcatttgttatcagtttaaagtagattgtaataactttaggagttttatgtaattcacatagtaatagtaaagaaaatatctatggaatacatacaaaaaaaatgagaaggcagccctgatgtatggcacatatatatttataattgttatatctttttgttgaattgacccttctatcattacgtaatgcccatctttgtctcttgtaacagttataagcttaaagtatatcttatctgacattaatataatcacgcttgctccttttagttaatatttgcatgcaattttttcccattattttactgtcaacctgcacacatgtcctgtgcccttaaatctagtgcattgtagacagtatacagttggatcatagtttttcttttaatccattctgccattctaggtcttttaatgggggaagttaatacatttacatttaattaatgtaattaataataaagaaggacttactattgctgtttagtagtttgttttctgtatgtcttatagcttttttgtccttcatttcctcccttcctgccttcctttgtgcatagctgactttttgtattgacatcttttgaataccttcttatttccttctatatgtattctatagatattttatttgtggttactatgcccaacaccactaatcattaggaaaatgcaaatcaaaaaccacagtgagatactatctcatactcattaggttggctactatttaaaaagcaaaaatgaaaataaaaaatgttgtcaagaatttggattgggatgtaaaatggtacagctgctgtagaaaacaatatagcaattccccccaccttctccaagaattaccatatgatccagcaattctgcttctgggtatatactcaaaagaattaaaagcaaggacttcatcaggtttttatacacctatactcatatcagtgttattcccaataatcaaaaggtgaaagcaaccgtagggttcactaatagatgaatggatacacgaagtgtggtatatctgtatgatggaatattattcagccttaaaaaagaagtaaattatgatacatgccacaacaaggataaaacttgaagacattatgctaagtgaaataagcaagacacaaaaagacaaatatcgcacaattccatttacatgaggtgcctagagtagtcaaatccacagagagaaaatagaatggtggtcgccaggggctggcaggggggagaatgaggagttgttgtttaatgagtatagagtatcagtttgggaagatgaaaatattcagagctgaatgatggtgatggttgtacaacaatatgaataatgtacttaatgccattgaactgtacacttacaaatagtcaaaatggttattttatgttatgtgtatttaccacaattttttaaacagcttttgaagtaaaagataaaaatgaattagatgactgactcggatgaggaaaccagctgagctaaggaaaagatgaaacgactgtaatgaaacaaaaagacttttctctgctgaataccaaggggcttagggaaggcacagctcctccttaggtgaggagtagaatgagcaaggagcagagatgtatcactggggatctgcacccaaggaggcaggtcacacagttgaggttcacactttggaaaggatgcaaccactgaggttacatggaaagaaaggagagacaaaaggctgaaattaacctggaacaaaagtagcaaaatgaagctcagaataatgagttattggaggaaatggaaactaaatccataaggagatgccgctactagtcactactagtcatttagccatacaacagctaaaactaaaaacggtgacaatgccaagtgttaacagggatgtggagcagctgggactctcagacagtgccagtggaagtgtaagttggtacaactataacagaaacccagttgacaggatctactaaagctgaatatattcacccctataatccagcaatttcacttctaagtatttacacaagaaaagtgaaaatttatgatcaaacagccttgtacgtgaatattcatagcagctttagtcataatagcaaaaaaactgaaatgaatccagaagtatcacaacaggagaatggagaaacaaactgtgatatgcccacccaacagaatactgcttagcaatagaaagaaccaaggtgctaacccacacaagaaggacgaagctcagaaacatgatgttgggcaaacgaagccagccaattatctgacattctagaagagtcaaaactacagtaacaggaagcagatcagtggttgcctagggatggggcgggaggcttgactgcaaaggagtacaaagcaactttcttgggtgctggaaatattccagatcttgatggcagtggttacacgggtatagacatttgccaaaatgcatcaaactgtccacttaaaaagggtgcattttattatacaaattatataatacagttgttgttttaagtgaaggatttgaactttatatccaggacagatgagagtgggaatgagacatggattggggacagagagaagtataagaaagcaaggaactcacaggaactatagagggctctgggttgggatctgggtccagcttatcagctctctagaggcaaggaggtccagtcaacacatgggatatgtcaggaaggctacatcagagttcaatactaagctgcaagcagtgaagtgcagaatcagtacttaagaaaaacaatgtgggatgtggaacatttgcacaggaaaaggtttcaagacataaaagccatgcaagagaaaaggagagctgtgcaagagcgagaagagaggcccttgtgtgggccactgatgtccccggggttgaggccagaggtggagcagcatgatctggaaggaaagcacaggcgtcaggttgcaacagaggctctcatcttgagacagcaagctgagctttagggaccagggagaccatggctggtggtcgccgcctggaagctgaggacagagttgtttatgatgagcacccttctagaacatccaccagcgtttgcagcccgctctgggacagctggagaaaatggcctggaggctggtccagggtgagcagaggtccctggcacacgtgggctcctaccaggagggctgtctcctatggcacctggcctgagtcactggaatggctcctgagccccccacccctaggccctgtgctcctgcctgatgttgcccatgcctgcgtgagcctggctggtgccaagagccaaagtgctcagatgatccagtgctcatggaggaccactgggcccttggccaggagcagggggccctcaaaggcacctccacccttgaccgcccctcactgacccactcctagctctgcacatatgtgctgatagcctgaagccatgtacctcctggtccccatctctaggcacccacgggagctaaaggtgtggccttgggaagggggcttcatggaggctgcagtgcctggggtctggatgcaaattactttttggggtgggatgagctggggtctgggctgcacgccctgcctggtctgtactcctgctgcactctcacagcaatgggaaggagagtcaggtgggagctgcggctgtccccggcccctctgcaggtcttctgctgtccattctcacagagggtggtgggaacggtaaatagaagatgacggagaatggccaggtgaattctaagcctgtgatatctgtgtgctgttatttttatagctctgatgtaaacctgacttctcatccaacccagacatggggtgtggagaacggcatagagctcagaactggcctgggtgctggagtggggcatgggtgggagtggaccaggctgacctctggctgggcccagagctgcaaggtccccaagcggtttcctggaccagggtgagctggagaccaggggggttcccagaggccagagggaaacctgaggcaagggcctgcggggcccgagcaagtgggctctgggaagagaccaaggctagatagaatccagcactcgccactgggctgtcctctaagggatggggtgggtttgtgaatgtgaaccccaacctcgtgcctggcaggggcccacagcaggcccaggggcccacactgtcctaatacagaagagactgccaccctctccaactccactcaccttttttgttaaatattttttcccccaactaattcccttggttttcctttgtgagttttgtttttgtttttgtttttgttttttatgcttgaagttttaaaactatagaaaagtacagggaacagacaccagcatatccaccaccagcgcctcatttcaaagaaagggaaaccgaggcagcagcccacagctggaggcctaggagtgtccatgggcatggactgtggagccgctgctcaccagggagcaaattgttctgccacctccttactcggagacaccgagcccagcccgagccacagggtgacaggacgtggaggtcacaataacctcccaagctcactgtgcttattgtgtttaaggctttatcgcttcagtccttccatacagcactgccactgggacttgggtggctccctgggcaggcagggctgaagctgctccaatgaaacagctgtggccaggaggctgggagggtggagggaggcggggtcctcatccaagcatccacactctgaggagggcaggggccactcccacccaaggacctgcactccccaaggtgggagagcctttctggccaccgatgcttcccaaaggcccaaacccactccaagggcacctggagaggcttcaggtcctgagccccctcagcattgcacggtacagcctcctggaggaggcagcaagtgaactgcagcctgcctgtgggcacaagaggaccatgtgtgaccccagctatgcccctggccagtcctccatggccccacaatgcccttctgccctggatgcagtgggatgcagagggcgggtcccatggaggctgatgcgcactctctgcagctgtcggcagggctctgaagcccctgctcctctccagcttccaaagaacctgcagcatccctggaggctgtggtatctgtcactcagggccagaaaagctccagggtgaaaaggcaggtccctcagagaggcccacacccagtcgctcactcaggcctaaagagagctcagactcagtcatgggagccacagtccctctaactcctgccacaggacaggcttctcgggcccaagtcacatcacaggaattgagggagctgggaaggagtaggtcagctaggggaggttagcagcttgcccaaggtccctggctgagtgcacctccagggccgggggtattttgcacttggctgcagggagctctccacccaggaggaaagctttctcaccactgctcttgctggcttctccctgagctcctccaggctccctacccaagctggtgtccagcagctggactccagggtcccctgacacgcacctagtgccctatagaatgcatgcttcacccccactctctccgggtggggctgccctgagcatttgctgtgcattctaattttcagagggagcctgagaacgtgaaatggttcctgtccctgttttatcgatgaatgtactgagactgctgagatcgagccacagggtagggtcatggagttgggcctctgagtttccaaagtgcttaggcagcccctgatgctgtctttttaaaaaggcagagcaaagcctgcctcctctctctgcacagacccctaggtcccagaggagctgccgcacagccacatacacacacacccacgcacacatacacacacgcccacgcacacatacacacacatgcacacacacacgcacacacatgtatacacacacacacacctgcaggagcccccccccccccgcccccaccgccagcaggccagccattcccctggctccggggagctaattacatcacaggaaactgcggtgtgagtctcacatcatcatggtccccagtggagcgccgagacagaacacatgtggtggagctctgggccaggcccagctgcctcaggtgtccccccagctggagcgcagccaggcgctccatgcagctcagccagggaagggccttcttgctaggccaagggtggttagagtggttctgagagaggcctcgggcccaagcagcctcctctgcttccttcttgggtgtcctggcctggggcatgttgtccccaaaacaggacaacgttagtcctgtcgccctcagggagggtatgtgagaccctgcctagaaaggcggcacacaacacctggtgcagaggcacaaggacagtgtctgtgacaacagaaacactgtctctgcccacaaggggcacattcagggacacgagacccacgtgcccgaggctccatcctcactcatggcctgggacacacgggtgccactctcttaagtgacactgccagtgagcccatggcccatgggaccagaattctgctggggactccaaaattcctacagagggttggagggctcaggcagggcactccaaagagacatgtgagctgaggctgaggggagagggcgagtcagatcggagggagaaagggcatggggccgagaaaacaacggcaagggcccctggctgcaagctccagccagagaggtgggcagtgcggcccaggaggaaacatggccggagaaggaggggacaggtctcaaagggctgggccttcagaaagaaagcgggctgtatcccactcacagcaggaagctaccaaaaggtgtgcatgacagtgacatgcacacaagtccttttggaaatttcatgctggctagtattggggagggcacaggatggtggtggctccagggggtgatggtaacgatggagatgcgaggggtcccaaggacagaagacctgccatgctgtgggggtggggtgctgacaggacctgccatgctgtggggtattgtggggtggggctgacaggacctgctatgctgtggggggaggggctgacaggacctgccatgctgttggcgggtggagctgataggacctaccatgctgttgggcagtggggcgctgacaggacctgccatgctgtggggtggggttgacaggacctgccatggtgtgggggacactgacaggatttaccatactgttggggcgggggtgctgacaggacctgccattgctgtgggatggggctgacaggacctgccatgctcttgggggcagttgacaggccctgccatgttgtcagtgggggttaacaggatctgccatgctgtggggggttgggctgacaggacctgccatgctgtgagggagcgctgacaggacctgccatgctgggggagctgagaggacctgctctgctcaggagggggaagggggagaagacagagagaggagggtagaggtagtggtggtgggggatgaagtccaggcatgagtgaggaggaggctgggttagtgcaggaagctgtaagtagacatggaagggaagagaggttctggggtagaatcagaatcaaagaacctcagaaagttcagtggagaaggatcctgtggttttctatctcccgaagtaaaatgagaggccagattttacctctaaccgccattcactataacccatccctctataacccctgaagcattccctggagacctcatgggctcatggaacacacattgaaaaccctgcagtgggccagtgggtggcctagagccatgtcatgggttagtgctggagcagggcagttccaggacattagaggccagccctgggccagctccccaccagctgaggctgagtcccaccagcagcatccctcacctgagagctggcctgaagtcctttcttcctttcccctgtccctgtttcagtgaccagctgctcctccctcctcctgggcatgctccactaaggcaggcatgcaaaggccagtagggaggcggcccctggactttcccaggcagacagcagtcccagaagagcgtgctgaaggagggacagactgactgctgcgtcctgggtcacccccacccaactcagcccacctcccaaagctggagcccctctcaatgtctcagccatcagggcccaagagctggggcagcttctcgaagctcaaagctggcaggggcaatgccaggctttgctggcaccagagggaccctgtgggtgtagcactgacttcccccgaagccagccgctgtgtccacgcagcctgaggacccaaggggaccttctggctgtcccagcaggaatccccacatgagtactcttgagccaggtgcccagccagcctggagatcacccaagatcctcaaaggttacagagggagttctgcctcctcacttcctggtcctgcaccctccctggagcaccccaggagactgcccccatactagccttgggaacatgggcaggttggagaccagccaggaatgagctcatcccctctgggggctgcctcctcatggcaggcccttccccgtgagggagagatgggggtcttccagttttctggctctgcgtggctatccaagaccacagtcctggggggcctgggaagcccagggtccttcaaccttgggccaggccatgggaccattccccagggcagagccagagtaagtgcaggcaggaaagtaggggtcacttttagaaatgggacctatctgcaggtgtggctccctgtcctgggaggagaggacagttacatttttttcttccatctatgcaatacttaaaggccaagagggcatttgaagcagacctcccatgttcactccaagtcacacagatggcctacactccctcattcatgtctctgctccctacttaggaggggctgcagccagggtaggggaccctcacccatctcccagtgggctctgggcactcacctttgaggtcaggcacagccacccctccctctgggcttcagggaagtttgggccgggtaggcatagggtgcctcctgctggcactcagggccaaggcacggagtcccttcttgggactgtggccacgctgagggggctgtcatgccatgagtcagccagctgtcagggacctggcccccaattcttccctcctgccctccccacagcctgcttcacactggacaggtgccccgactggctggcctgggtgtcctcaggggccacagcaggtaccagtggccgcagcccctggagggatgtcattaaagccagatcagccacaatccctggctctcacaatcccagccctgccgctgacaaccctgacgataagtgcaccccaaagaggaaatggggcccagaagcaaagctctgtgccatcagttcagctctcagacctctatgggccctgccacgacctgatgggctccattcctgatcaggagctgcactgggcatcagtcgcatgcccatggggtgggcaggggtgctcagcacctccagggagccctgactatgcaaggcctccccacgtcagatgtgcttttgcccctctgcttggagtcctagttctgccccacgtgtgcccagaacaatcagtgtctccaccctcaggccaagagcctgtgaccttgggttggagcctggccctggtgcaggcctgcggatctccttccacctggctctcagcctccagctacagggagtccccagatctgacccagggggccgagaccccaaagaagaggcctctgtgtcccaaccttgctgtgaggcatggtccactgttggaggggctgcagccactggatggcttctcatcgccagccctcccccgagggcgcaatgagactgctccactgtgactcccatggtccccgagtccctgtggaaagagccccagagggaaaggcggggtggaactgggctcccagcccccctacctgccagggacatgaccgaggcccctgggcaccccactttcaccttgggaaggaggcagcatggcctgtgcagttgcccctcctaatccacaaacgtgtggcctttcctgctgaatatgatggtgactgtcagcagttggtctcagcaggatcatcgtgccaattaagatggaaatgccaccctgtgggggctcccccctctgccagggagctgaagtggagggagtatgtttatacccaaatgcaaagatactgcccagcacagacttctgtcccagggggccggagagggatgtcattaaggccagatcagccaccacccctggctctccctgccgggaattccctggacagcaggagtaagtggcccttccttccttctctgcaaaagccccaaggtcacaggcacctctgaaacatgccccacactccccctgcttaccaggcctcatttcaggacctcctacccggactacactccaggcccagtggcgagacagagacacctgcagggctcccggattgggggcggtgaaaacctgcacggtgcacgccccagcagaccatagtcctcatgccagctggccagcagctgcacagaggctggtgggaagcaacttcctgacacagtcacccctccccagaagtgccctgtgaggccagggaggtgaggacaggcaacccctcctcagaagtgccctgtgagggctgagggagaagcacagtctcagctgggcctggccatggagacggatcccagtgaacaatattgattgtttgtgcaaaatggcaccccagcccctcagcctgcttgctgccagggcccctggtggaagctgacacagacacaaaggagaggaaggggcacagtgcagcaaagccggaggcagagcagtgaggcacagctgggggcccctgggccagcacaggcatctgaggcccagccacaagaactgcagtcccatagaggaaggggagggtgtcgcctcactcccaatctgtgcagcccctcagagccctgcacagggccaacagagtccgggagggtccctgtgcctgcaagggctgcggcctaggcctctgcagaacagggggaggggagcggccgcacccctgtctagacggctcctgctgagtactagctcctcacctacccgccctgggtgccacgggccccaaggcagagggcataagctctgtgcaaacatcctgccttctccccaggatatttcctttaataaaacaccatggaaatgtcagctagtctaaacaaatagccaaggttttcagaggacgagcagcctgcataggagagcctccagggcctgcttttcggggtggctttgggaaattgtgtgccagaaaggcagtgggagcccttcctggtggggcgagcactgggggttgtggtgactgagcccaaagaggcagggcctgcgagttcccctgggaggaaggggcaggccctgagccgggtgcagggtggctgtccagggtccctgaggagcctggggccttcagatgagggctccctcctgaggaccctcagaaagggcctgccccagggacacacgcagaggtgggggtgggaggcctacagcacatgcttctcaggacaccctccttcccctcccactgcaggagccacttctgcagccccatcctcctccttgtccataagctccatgttaggggaggcccctgcttggggaggccccaggtcggccgggggaggtgagaagtccaataatggggtgaaacttgcaaccccgtgcctgacaaaatgtggcccaggcccagcggtggcagggttggggtaggggtgagatacgtgttacagcccccggcagcatccagggcctgcatctgtgtgggggtcaagtgttcccgtgatcctactgcctgagcagcgggccgtggcatccctgctcttccttggcagggcagacagacccagctctatccatgtgcagggcaacgtgggcagggcccagactgcctccccagcaaagaaagattttcagggtgtggatctccatgtgggttcagcctctgtgaatggtgtgtccgggaaggggccacacgtgcaagaattgctgaccctgcctgggccagtgcaggagagtgaggctgggcttccaggcactgggctcgggctgtgccaggtaggccaacgctcctcaggaggccagcagatgcctgcagggtggcagtgagggtggtcccagcccttggggcctccatgcagccacctgcatctgtggccacgggtggaaaaggtgagcccacagcaggtgggatggccaaggctgagcaggtccacaaggagcagagatggaagccagcagccagctctgcaccaaggcagggcctctgggcaccgcctgggaagaagggagtgggctctggagtcctgtatgctgtgctagaatcccagctccatttcctcgcctgtgaacagggaagtggtttctagccaatgcggtgtcagaaggagagaacaggatgaggtgcctgggcacggctcagcactgagcactcggtccctccccagtccctctgacgaggcacccaggcaggccctcccctagcagaggacaccatccttgggcctctgggtggcagatggcattttctcaaaatgcccacaagagtatctccaatcccacacattctcagaaccttgctactctccaggagcacacctgtttccccttccttggaccgggtgcagggcagaggtggtgggtagggcccgcagaggccatgcagagtgaaatcagagactggggcagatagggcgactcatttctgcctgattccctctctagggaggttccccttggagcctggtcccatgctgtgaggaagcccaggtccctggaaaggccacatgcaggtgtcccacctgagggcccagcagcagcctccgctgccagaccgagcaccaggagccctcagatgcctccagccaacccagctgacacaagtggagcagagacacactgtccccaccacaccgggcccaatgtgcagtttggggagcagaattaatattgtcagtgaagccactgtgctgcggggtggtttgttaagcagcagcatgacggagcattggtgcactggctgagtgacaacatgactgcagcgcccccatctctgtcagactctagccaggggacggggcccactcagaaaagcctgtttcaggagacaggacctggtgaccattctgtgcctcccatcccgaggccccagacaaggctaggcttggaatccagaatgcctgggccctcaggacacagtgccctgccccccaggagccaagtgctgagacacgcactgttcaacggcctcattcagaggatcatgcacccgggaaccccacacagtcaggactggtgtttttcgtaggaggaatctgaggctccaggatgggctgagtcccttgtctaatgcgccctgcttgaccttggaagagacacgctggggactgatttaaagccgccactccatacgttctccctgcagctcccatgccagccactgccatccctgctgcaggagcacagctctcagccacagacgcccccatcaatcaatatttttaattacttacatgattgactaataaaattctccaccaactaattgatttttttgatcagagagagcctttgtttttattaaaaggctacttagatgaatttttttttcacttaagtgggaagttgtatttcttttggtcattttggaagaagaaaaataggagggggctgggacaagggaagaccccgaggccaagaagattacaggcccaaactgagagacccatgataatcatcagaaccccttcaccatgtgcccaccaaacacccagtggctcggctctggccagaggagccctgtggcatgggtgggcagactggggacacataccacccaatcgccagcagcttccatcatttttaaaggtgaactgtaaacttttctctgcattttaataaaagaatcgggcttgaaattataaaagcaactcattcattgtgtacagtttggaaaagaaaggcaaatctcataaaactatgaaagtgggcttcctggcacggggcccatggtgcatggggcaggtgacctgaagctgtgagaagaagctgcagggttgacttcggtttcccaggggcccaaggccccaaagagccatgaccataaaaacaatctggacagccacccaccacccagaaaactgctcatgggctcacagatcagtgggctttttgttgttttcctttttcttttcctttttatttatttatttattttagagacggggcctcacactgttgcccaagcggcaggcagtggtgcaatcatggctcactgcagccttgaactcctgggcttaagcgatcctcccacctcagtctcctgattaggtggtactaaaggtgtgtgccaccactcccaactaacttttaaatatttctggagagacaaggtctcactatgtggcccagattggtctccaactcctggcctcaaactgaccctcctgcctcagcctcccaaagtgctggcctcccgttttcatttttcttttaccagattggcatcttactgtagatcaggtgtggccatgttcctccacttgcagtgacctttaaagaggtgtttgtaagtggctccagggcagcccatcctgggacctcttcatgtggcacacactgaggttgtcttccctgggcagctgctgggcacaggatgatgctgggcacaggatgattctgggcagctggtagggccagggagcttggcagcgacaattagggtaagggatggtgggcatgtttggtgaaggaggggcagggtacagggtccccaccacagccatgggatgctccttctctcctggctggagggtctcagccagggggacacagtggacagggggtgttgcccccagctccacactgggcctgccactgcctctgcctgttacttccacagtcatggtcacccactgatttcactgtgacctcatctcttgttggctgctccatgccctacgagcagagcagtacccaggatatggtggatgctctgagaccaagttacaaatgcttgctgagtaaccctacagaaatgaagaacattcttaccgtggcctccacatggcccttctgagtggggccctggggctgtggggaggatgagcctgctcccttaggagggtcactgcagatgtgcagaatgacaatggaatgcagaggtgatgggggcagagctgtccctgtgtcacagctcatccacacagactgggtgagggctctgtgcctcatgccagccccatgcacagaactgagtcctcgaagacagagggactgagtgactccccaggccacacagcctgtctggttctccccatgggacgcttctcaggctcacccggagctttcaaaacagattcctttgcccgtgacctgctctcagcctcatgtgaggcctcagaccagcagggttggaacagagctaatgacatggcagggaaacatgtggatggttagcgacatgaaggcccacccagctggccctagagtgtctcgcctgcctgacagctccagtctgtcaccctgactgggcatgtccagaagcctggccctccgtccttggtgatctcatgctgcgtggcttgcacccgctgggagccgatgccaccacgccaattgctgcaagcctctgaaaggcacctcgaggtgtcctgatctgtccccaacatgcaacctgcccctagatgccctccccaccacagcaggaggcagttttgtcctgctcaattggaaaccctgggagctgagtgaccctgccgtttcccccgcccactgccagccacatccctgctgagaaaaccaagaagggagttggagctttgatcctcactagctggtactgattcccccacctgcagcagtgtcagagaagaccacacagaaagccagaactcccattcccacccagctgtaatgaggagtccccacctgcacctcaggtgtcagcagaggctgagtgagaatcccaagcttctacttctacctggcagtgagaaggtactgcctccctttccctgacagaggctgacagaaagtaccagctgaaacagaggcttaaataagacccagaagccgggcgtggtggctcacgcctgtgatcccagcaatttaggaggccaaggcaaacggatcacaaggtcaggagtttgagaccagcctggccaatatggtgaaaccccatctctactaaaaatacaaaaattagccaggcgtggtggcgcacgcctatagtcccagctacttgggaggctgaggcaggagaatcgcttgaacctgggaggcagaggttgcagtgagctgagatcacatcactgcactccagcctgggcaacagagtgagactctgtctcaaaagaaaaaaaaaaagacctagggtctcataacaaaatatgagaatatctaggtttctaaagagaatttctagtcataccaaaacccagggaatctcaaactaaatgaaacagtcaataaatgctgacatctacatgaaagagatgttagaattacctgacaaagatcttaaagcagtcatcaaaaaagtgactcaacaagcaaatatgaacatgcttgaaacaaattgtaaaatagaaagtctaggcaaagaaagagaagatacagtacaaagaagaaccaaaggggaattttagagttgaaaattacagtaacaaaaatcagtggatgggcttaacagaatgaggacaaagggaagaatcagtgaataggaaaatgcatagaaatcacctggtcaaataacagagagaaaaatagactgaaaaaaataaaagaggaatccaggagactataatacaagacctaactttcatgtcattcaagtcccagagcaaaggagaaagaggattggctgaaaaaatactcgaagactggaaactccttgaatttggcaagagatgtaagcctgcaggttcaagaagcttcataaaccccaagcagaataaaaccagacaaatccatgccaaaacacatcataattaaatttctgaaacataaaaaaaagtcttgaaaacagcaagagacagctatcttggaagacagttcagatgacagtggatttgtcatcagaatcacagaggttagcaggcagtggtataatatttttcaagagctgaaagaaaagaactgtcaacccagacccttttacctagttaagtcatccttctcattcgcattctcagatgaagggaaactaagaaaatttgtcaccagcagacctatgctaaaagaatgcctgaagaatctgtccagacagaaagcaagtaataaatgaaagaaccatggaacatcagtaaggaagaaaaaatgcagcaagcaaaagtatggataaataaaaatagggttttgttatcccagagaaatgaagacatgttcacacaaaaacctgtgcacaaaaatttatagcagctttatttgtaatatccaaaaactggagagaaccagctgttctttatgaaatgaatggtgaaacacactctggaatagccacaccatgaaatactgctcagcagcaagtaggaacaaacttctttttttttgttgtttgagacagggtcttcctctgtccaataaggtggaatacagtgacacaatcatggctcactgcagcctcaacctcccaggctcagatgatccttccacctcagcctcccaagtcactgggaccacaggcaggtaccaccaaacctggctaatttttaaaaatttttatgtagagacaagatgtcactatgttgcccaggctggtctcctgggcgcaaatgatcattcctcctcagcctcccaaagtgctgggactacagtcctgagccactgtgcccggctggaagaaactattgatacaatcagaaacctgcatgaatccccagaattactctgaatgataaaagccagccccaaaaggttacatattatataattctaattgaaatgccaaaattatagaaatggataactgattagtggttgctagggattaaggggtgggagggaaatggatgtggctataaaagggcaactagtgattcttgtggtgatgggatattctgtatctccactgtatcagtgtcaaatcctggttgtgatactgtattacagttttgtaagatgttaccactgggggaaactaggcaaaaagttcagggatcttctgtattatttattacaactgcatatcaaactacaattatctcaaaatagaatttttcattttaaaaatatgatgataagattagaaacagacttgtgtcctgactatattgtttaattactagagattttgctatataaaaatattaagtactagagattttactatgtaaaaataatcttgcagtggtgggggatggggagttattcctccggaaaataagacactgagatgcctagagaaaaagatgatggatttgactagataaaaatgcaaaacgtttgcatgactaaaggccctatagacttcaaaagacaaaccacagaatggtttattattatttgggtttgtccactgtctcctcgatattagattcaggtcacgcatttttggcaggaatgctgcagacctacttccgtgccctccttgatgcaccacaccaggatgaatttggaagtttattccatcactgatgatgatatcagctttcactatttggtgaagtcaatattcatttgtagtgaaaattcactacaagacacacaaaatagaaaagaaatttaatacaaattcaaaaagcatttcatttagtaaaaacaaaaatgatctaatagaaaaatgagcaaagattacagatcatttaaaaaataacaggaagctgcgaatacgtgaaaataagctcaacatcactagtgatgagaccaatgcaaattcgagtacctgtgagttgccttttttgctcctaacacattggcaaaattatttttctccttaaaccttgtgtttgaaacaattccaaacttagagaaaagttaaagaatagtgcaaagaactcctatacctcatctccccagattcaccactgttcacatttttcttcctgtgttctcttttttttccctgtccctcccccactctctccacatgtatatgcaatttctctcttgaaccatttggcgatgttacttctattcaccatgcctccttgctcccaaatattaaatctttatcttccgtagacaaggacatgttcctacttagccatggtacatctgtcaagtactgaataggaaagttagcattgatacaatactgttatctaaccaaaattcatattccagttttgtcagctgtcccaatgttgtctttgacaataatttttttccatccaggatcacgctttgcatccaatcatcctgtcccagtggtctctttaaactgggacaccctccaccttcctctcctctagcattcacattttggaagggagatttccacttaggctgtagactgtgcctccatttgggtttttccactgtctcctcaggattagattcaggtcacgcatttttggcaggaatgctgcagacctacttccatgccctccttgacgcaccacaccaggatgaatgtggaagtttattccatcactgatgatgatatcaactttcactatttggtgaagtcagtattcactgggcttctcaattaaaaggttattatttttccttttgtaacaaaccaggacttttatgggcagatactttgagtctatgtgattccgtgttcctgcacaaactttcaccctcaaatttagcatctgctgatggttgttgtctgaatcagttattctaattgtcaaatgattatctttctaaattccacctacttttactagctgatgctttattatactataaggacaagcttttccttatctttttatttcatatcgttattggatgatgagctcatggagtcttattttattcaggggccataattcattcctatcattcattctgatgcccagaatgtcccagctgggccaatgggagcccctttgcttggttcctgtgccctgtaatatgctttccttgttctctgagtccttccttactttcagtgagatgttctaacctcattttttttctgctccagccctggaaacttttctccagggagccctggttccttttagtggagacagaatttagaaaccaagatgtgagtgctgggtgtgctcatcgttactctagaattcctgaaggcctggggatggagcgctctcattctcacttcggggagagagctgatgcaacagtttaaggggcatttggccatccttgtcaaacgtggccatgtgcccatctgcacacagacacaccatttgcaggaatctgttcgacaaagaggagcacacaagtgcataacaacaacccgtggaagcaaccagagtgtccatcaaggtcagctaaaaaaaaaaaaaaaacactgagctccctccctttctaaacgacactcagcgtacattgaaaataataagactgatttgttcaagttcaagaattactaaaggagaagaagcaactaatagagtggcacatgtaatctgatttttaaatacatttaaaataaaatgtgtgtgtgtgtgcgcgcgcatgtatcttatatacatgagtgtgtttgtataggaaatactctggaaggacgaagtccaagctcccaagtaatgttatcgctcagagagggtagtgagcagaggtatggaggctggtaatacaagcagaaaattatagtttttatttcataaacttctgaactatttgaagactttatagcagccatatagttcctctatctgtaatattttttaaaagtgttaaaagacaataggccaaaaacgacagccggctctctagcctacaaaactggccagcactgttgaaatatactaaagtagttttaaaaataaagagaaaggtactcaccagaagtgggatcaatcggccttggaagcagaggaagaagagaaggaagaggaaaccttggcagtgtttattgtacctgccctggagcagaggtggggccctggcccatcttggttctctgtgaagtggccctgcaggctcttggggacatccccaggctcttgggaacatccagctccccagctctgatcctacccaccactggcttcccctgagtggtccacagggggagaggatgtagtggcaccagccataggaccagaggtccctgacctgggctgtactgctcttcctcaacttctgatcatatagatggatccgcacgtggtcaggaggatggattctggagtcagactttctgaattcacaccctggctcaccgctcactgacttggaacttggaacatggcaatttcccccctacccaacctctctgtgcctctctgtgcctcagtttcaacatctgtaaaatgtccccatacagttgttggaaaggtcaaattagtaaatatgccaagtgcctaggacagtagctaggatgtagtagactctccaaaacgattgtttgtgatattattcctagaagtcacagtgggcacacccttctcttttttcagaatgtaacaggaatgaggccagggttttactcttaggtgtgatattcctgatcgtttgccatagtggtgtgtattcgctaggaatgctttcaactgcaacagttccaaacatagcagcttaaacaaataatgttttgttttgcctccatttacaagaggcctgccagtaggcagctgctggcctgggttcagcagttcaaccccgtcagagctttgtctatctttcatgcattctgcctcagggttgcaatatggttgccccagtgcctggcatcacatctatcttcaatgtaggaagaaaggaaatggaaagaaaagagctgcatttggctcttttgacaagaaaacaaaccttctcaaaatatcccagctgactgccacttaggtctcatttaccagaactgtgtcatttgaccacacttagttcaagagaggctgggaatatatttagacttttagcctcaatagtgcagatctcaagggaaaggcggttggaaacagcctcatggagcttgccactattttctttatcccattaagaagatccgtatggcccatgtttgagtgacatgtgtttgagtgaggaatggttggtggcatacaccaaatgttttctcagcagagggaccatcccagtgtctctatcccgctcctactctaggggtccaattaaatggagtcccacctattatgaagcagcagcaggggaaattcatctgtgggggcagctgggagctccaggacttagcaaacctgacagcctgtgcagaccaggatgcagggcttccaaccccagccacctccctgccgaaatggccaccactgccagctccaggttgctggaggaagctggaggctgccagtttgctagctccaggctttgacagcaagggcatctctggtcagtgcctcctggattgttcaacctgtttccatcttccaggctctcaggagcactgggcagtgcagtggggtgggggcttgggagctcccatgtgtgacagacacagctcccagcttcccttcacatccgcaatgcaggcctggctgatggtatctagttcctgagaccctgcagtgaactcagatcccagatactttcccttgataacagcttcacctttttcatctcttttaacaaataccaactcctggctgaaacccagactcctggctggataccaagtcctggctgaaaaccccttgctgcttcccagaaacagcctggtctgacatggtcagtggagaagagagtgggcctggtgcccacagccacttactgccttctctgggccccagttcctcctggtgaaatcgagagggtgggtaggatgcttcctggctgccccctctgtgcacaactggtggctgtgggtcctggttgcccctctgtgcacactctgtggttgtgagtcctggctgccccctctgtgcaagcccagtgggtgtgggttctagtcaccccctctgtgcacacccggtagctgtgggtcctggttgccctctccgtgcacaccccctgatgtgggtcctcattgcccctctgtgcacacctggtgactgtgggtcctggttccccactccgtgcacacctgatggccatgggtcctggttgccccactctgtgcacactcagtggtcacgtgtcctggttgccccattctgtgcacactcagtggtcatgggtcctggttgccccactctgtgcacacccagtggctgtgggtcctggttgccccactctgagcacacccagtggctgtgggtcctggttgccatctctgtgtacaacctgtgattgtgggtcctggttgccatctctgtgtacaacctgtgattgtgggtcctggttgcccctctgtgcacacccatcttgctcctcatctggatgaagtcactgcccatggtggcctcatgcagcctgtgatgctgggctctcacttgctccactttccagatgaggaaactgaggctcagaaaagctgtcccttgcctggatctgagcctggtcttgcagcccagagctcttgccacctggctgcacccctggcagtgaccaaaattgttggtcccgacccagacctcagagggtcagtgaagagtgtcctgggttggcttctcctcccctctgcaaatcctctcagcccacactctttcagcttctcacagaccacatgaaataatgtgatagatgcaatatgagattaggagctgaacctcacccaggtcaggaaattccaagcgcagtctcccagctcagctctggctcccgtatgctgcccccaggtcgcagcggggtgtgcaggggaccattgcaggctgcaggggcacctgcatcctctagaacttcctgaagaccagacgctctgattttccaaccagcaccagcccagtcatttccctctgcctccctggggactgtcccagccgccatcccttgctcctgcctccctggggactatccaagccaccatcccttgctcctgcctcatgcgggtttcctctctagccagatcctccccgtctgtatccaaaaatactgttacttccctgtccttaagacagtgtgtttgactgctttgcttgtttgtttgctcctcttgatggtaaaactgctccagagatgtggccccatctggggttgccccactgaagccctccacagagactttgtgacacctgaccactaacctcacctcgctaaactgaggcagagcttggcaacagtggtgactcagtggctcagccctcctcttgaaacaccatcctcccgagttccaggacccctctgccaggcccctccctccttctccatcccccacacctccccccatcttcccgtggggggacccagtgctcgtctctattcacactctacagactccgcgtgacaccaggccccacctctgcaccctccacctcaaggatggatacaccttccgggctgtacccgtgaaccccagcctccaggtctacccaaaacctgctcaccatcaccttctcaggtacaaaaacagccctcttccctcacacccccaccgcccaacctgtggtctaccttggaaataaacctcacacctctggtcatctctactgccaccccactccccacccaaaccactcaacagccacctggacctgggaacatggcagctgctggaggtcttaaaggcgccctttccctaaggtaagctgaagcccagatgccagcacagccccttctcctctctgccctggtccccacctcctctcaccccctcactgtactccagtgccctggtctcctgagcaccctcaaacacatgtccccaaatccaattccgcccccaggtcccatgattccctctcttccttctacaactcatttctcaaataactcctgccctgctatcccatcttaaaccgcacccaccctggtgttggttagccagtgctgaggaacaaatcagcccaaaccttaggggcttctgagaacattacagtcttagcttctgcgggtcaggagcctgggcatggctcactgccacgtcccccacccccagcccagggtctcccataggctgcactcagggtccactggatcgggtcatctcagggccgggtccacctcaggctcccttacaaggcaggaatgggctccctctcaaattgtagcaagggctgccccaagtccctggcacacggtcccccagagcgctgctgaggacatcgaagcaagcaaggcaagagagggagcaggcaccagtgagacaacccacaggcctctgtcagacgggggccttgggggtggcagccatcccttctgccttttccatccattagaagtaagtcctggcccaagcagcctctggggaagggcagctcaagagtatggccccagcagtgggcgtgaagctctcctccccactgcgagcttctcactccccacgtaggcggctccagtgcccagctctttgtctgtctccttcaaggagaatgcaggctcttgagggcagggcactccctgtcgtcccaagcttcatccccaccacctgccctgtcacagcatcagcacagctcacagcaggtgctgaataaacactcgtgaacttcagaaagcccctcacagcacaggaggagaaatggccatcctccccagagacttcgctggcattttcctatgttacagcctgatcctaggacccactgaaggctggtttctgcaggagtgaggaagcctgggtgtgagcccctgaagctggggccatactggttatctcggcccagcggcctggaaatcacaccctccccagacttgtccccacatctgagaggagagacacatcgcagagcctggcctcgaggtctcaggggtcccataagggggtggggctaggttcattcttttacatatgttttcaaatattgctaaaagtcataaattgggccaggcatagtggctcaggcttatggtcccagcactctgggaggctcaggtgagaggatctcgagtccaggaattcgaggctacagtgagctgtgattgcaccactgtgctccagcttaggtgacacagaccctgtctctttaaaaaatcataaattgttagacatacttttggggaagtcgtttggtacacactccttgaccagtatgtccagatcctggaattactgatttttttctatagtcacacatgaatgcagagatgtgcagtgcagctttgtctataggagcaaacaaatagaaaagctagatgtcctcgagtaggagtggatgaattattacagcacagccccacggtggaacactgcacagccactggagtcccaggcagagccgcatctgggtgcatcaccatctacctctttatgtaaccagcagacagctatagggcctgcaccttccgagcactggaggcagggaaccgcatcgctgccttcaggaactttatgtcagggttaatgccaacatgcaaataagaatgcaaacacacagacaaatgcagctatcacaggggtgtaaggaaggcagagcaggacagggagattgggaacatgtttcacacagcaatccgggtggctgcgcagatgccagggcacagtgagggagaggctgcagcaagctggggccggcccctcccaggcaggaggaatggccaggcagggcaggtgggggtgagccagggtgaggaggatcctgtggcacctggcagccacactggcattccatactgatctgtgttacaacacaggcacccacctatcagagcagcctgggccactcgttgccagctgcagacaagggtcaggctaactggtgctgataagacaccagcccccatgcacctggtgtgatagggcgttgctgcctgccagtgtcactctggagcagatcagcaggggtgagggcaagggcaggggccgggaggaggctgcatgacccagggtggggaggccgacctagagaagcagagtggggcaggtcggggagacagatattctgaggggcccaggacctccacgttctgagacgctccgcacacagcttctggaaatgttatgtggaatgaaccatcatctggtctttcccttcttttttttttttttttttttgagttggagcctcgctctgtcacccaggctagagtgtagtggcatgatcttggctcagtggaacctccacctcccaggttcaagcaattctcctgcctcagcctcctgagtagctaggattacaggtgtgtgccaccacacccagctaatttttgtatttttagtagagacagggtttcaccttgttggccaggctggtctggaactcaacctcaggtgatccacctgcctcggcctcccagagtgctgggattaccggagtgagccaccatgcctggcctttttctttcatagacctttgagattgccgaagtcccttccaagactcaaatctactggctcggatacaggacatgggcatttggagtagacctccacccagacacaggaaagtagccccccatctccgtcctcactggggtccacttggcaacccagcccagcacttggacacggatggcctactctgccccagtgcagacagctccaggtaccaggtgctcctgagccctggccacaggtcagaccccattctgagaatggtcagaatccagagagaggcctcaggtcctgtgaccccgaggtgctgaccaaggacctcgcatgtgtctggcagcatgctgggcctcacaggaggaaagggggccctgggcccttcatgtacattgctgcaaggtgggcgctgtcatgtgacggggagtgtggaggcctcgggtggcccacaataggcagtgggaggacaaggccagggcccagcgcctgcaattctccatcacaccctgtgtgctgagcagccatccttcaccctcaggctcctcctcgtgggggcacaggggaccctggctcggggagtccatcacttgcacaggtgtcacaggcatagaagtccaaactcaatggatgcccttgcctccagctcccagctgaacatcctggctgaaaggggctgaccgccctgactttcctctgaggtaggtgagctctgggggctccatgagggaggtggctgtgtccaggccacacatccctctccaccaaagcgtctgccctgatgacatcacctcacaccgccaagccattactcacagaattacggcttgtctggaagttggatgagatgtatacaatgcaccaggatgacaaatcctccctttgagtgggtcatttcccgaaggagattccaaggattcacagatcagcgtatcctggcattgcaggcagtggaagccgaggcccctgagatgtgtctgggtctagtctcgctgtgctaatgaggccccagggccagagtggacactgacgtccctgtggggcagtgccacatgatcacatccatgtagtgaagaggcattctggactttgtccctaactcctggtggtgaaccatctttggaacctgatccctgggcccagactccctggtgggtctgacctctagcccacagcacagcaggttgcagatctcattgtccagaaacagccacagcaatatttctgtgttcctccaggatctggccaccactcattgagaggcagagtctatttctcctctccttgaaaccaggggtgccttcacaactgctgagatgaagaggagagagggttttaggtgacttccgatgatgggtcacagacagtaacgtgactctggccaccacattgtaaggaagcccagcggtcccggcccacagctccagcaagggagctgttagtcaaccgacagtcaacaacagccaccagccaccagttgcatgaggggagctcagtgttgccagccccagcccgcaagccgcctgccctaaatgagacagagctgagcagagacaagctactgcacggagcgctgcccggattgcagactcaggagcaaggcaaatgatggtgttgctttaggacactcagcttgggggtggcttctcattcagcgctagacagggagaacacaccctaggtgattccccggccttccctgggacttctgtgtctgcagatccctggtgcagatcccaggcaggcagagggccagagcccatctgcagtgatggttctgcatactgggcgggctccgatgggtcgagaacagctccttgggcctgggggcaggactcagagccacattcacggctgcaggagtcatggatccgtggccaccagggtctgtgacagggaaagcgctacaggctggaagccctgtctggggttatctatttaatgggagataaagttttcatagtactaaaaagtattagtcttcagaattagatatttgctcatttttccaaaggctgtgaggtctctgaatccctcctgcagatctgtggcaagctgtgcactgtcctgtagagaaatggccctttctagatctccactctaaaagcagcaataacaggacgatgcgagagcagagcctggccccaagcagcgtgggtccccaggcattaaggatcctctgcaatgggtttcattagatgagttgtctttggttttattaaaatatgtatgccctttttattaaggcagtattgacctgtgaccatgtgggaggacaagcccatgccccagtctctggctggagggtgttgccccctgggcctccacaggcttcctgatcaaccaccctgccatccatgggcacagaaaacatcaccaggacagcaacagggggaaggcagagtgcagctcccaccacgccgtggtccttggggtcctcagttggagatgagggctgcagctccccacctaggtcacagcccatgcccctctatcccagcaaccactggaccagcctctaccaaggccaccaccaagacagcaccaggccaccttcccaccagtcagcagcttcctctcaacctctattcgttagtaaataaattctgattcatgaagccataacaaaacaaactaaacaacaaaaaaacctatctaagacaccaacatccctgaaaaacaaacaaaccaaacaaacaaacaaaaaacaaatggtgctctgcattccctaaagtgaattcctttgcaatgtacatgagttgctggggctgctgtaaggaagggccatagactaggtggttaagtttactgccccccagttccagggctggaagtctgggatcaaggcctccaagggccacccgcccccttagggtgctagggaagggtctattccagcctctccttactcatagacagctgtgtctccccacgtctctcctcatggtctcccctctgtgtgtctattggtgtccaaatttcccttttataaggataccagtcatactggatcagggcccaccctaacgacctcatctgaccttgattacctctttaataaccttagctccaaatacagtcgcattttaaggtcctggggcttagcactccagcatgggaagtggggcctgtcctgagtcagcccagggtgggcagtgggtatgggagttgcccaggctgctcagagcagggcacacaaaggaggcagcagcaaagaagcactgggaagggctggttctcccatcatcagggacaaaggactgagccccccaacaccagctagccctgcggggattttgctgggagctgtaagaccagggtccagcagaagcagagggcacacgaagggggcagggactggggtttcctgtaggggcagaggtgtgggcagtatggggaacccccaggcctggagagaggctgacccagcaggagctcaggggatggtactggacctccaaacctggctgagaaagagggacttgggtgtgggggtgggggtcaccggggccttgccaggagggggcaggggataaacacactgtcctccccttgctggtctcccccagggcctccaggtggagggacgggtggcacagttcaaccgcccccacccctccgccatcccccttctgccccatgtggtgtatgcacaggatggggcagagctgagcaagcacagctcctaaagaggagggcaggaaacttgctgctcttacagccctgcagccgcggggaggcttgatgctcccagcaggggaaagcagagaggcagctcaggcatggccagcaagggcttagacttacaactccttgagggcatcagcagcacctagactggggatggcagagtgaacagtggctcaggcgagcttccccgaagtggggagtgcgggcccatcattctcacagagccacagtggtggtggatcacacaaaggggagaccatgaggagagacatggggaggggacagctgtctacaagcaaagagaggctggaacacactcttccctagcaccttcagtaggtgggcagccctcagaggccttgatcccggactatcaatgccatgagcatctccaagcccaggccccgggagggggccccactgcatgggcctcagacagcttctgaccagccagccccaccctgccccacccttacctgccctctccttccctggagaagcttgatgagaggggccctgggccaggcctctggaaatccttctgctgcaggcctagagctcaccagggtggaagagggaggggatgggatagcccagatgggcccctgctcccagcagcctccccaccccctgaacactcccctccaccccacctagccgggcaggcccagctggccccatttctcattactattgattatggtggcagagacctgcagcacagaatgtaaatcagcatccctggggtatttaacctaggaagggttaggtggaggtggcatcccttataagtcctgcatctgatgtttttatattaattcctatagtggccagattaatttttattccactgactattatctcttcttcattgactaggagacatttctgagaagtgcatatgtgttgagtatcagtcatttagtggggggcttccctggctgcaaggttttcattaaagaaggaaaattcctttgctccaaagactcagtctggaaataatgcgcaggccagctggtgtcactgccagtgctgccgtcacctgggagtggggtctgcagctgcctgggagcctcaactaaaggggcagggccccctagccgtccctcatcctccctctcctcccagcctcccaggcccagctttggcctcacacaggctctgagtgagccttcagcaagtgaccacccccagctcctcagcccttgctctgtgctggggcctcccctcccacatctcacagaatccgtgccccgactcggagtgaggtgggactgtcactgcagccattttgcaggtgaaggcaatgcacttgctatagattccctgacactcagtactgtacagggtcatggattatcttgggtgggatccaggcctagatcacagaaatgaccaccctttttgatggggtggcagaggcactggatgggtggcttccaagggctccgggccttgcatgaggagtccagctgaaaaaacgggtgtcagaaggccgagagctgtctgcaaacccaagtctctgcagagtgtggtgtggtgtgttctaggagcgtccttccccgctgaccagtaaggccagggccaggggcataagtccagggcactgaggctgggaacagagaggaacatggggaggaggatggaaggggggctcggcagctccggggatgcctggccaagctggacatgctgccagtaggtgggggagtgcctccactctgagaccctcacctgtccctctcccatcctacagggttgagaggagtggatcccaagtgtaggcccaaatgtggagccagcagcaacccagccactgggagctcatggcaagtgtacaccccggcccacaccccacatcccaccctggggcctggtgaccagcctccactggcgcttgggaaccatgagcagggtggctcaagggccccagagaagaaacacctgagctggagcctcagttagctcacctgtaagatagggatgttgctgccacctggggatgctgtgagctgagtgaattggaggggccagtcctgggctgcctacttgcccacatggtagggaggatctccaccagctgttctcaccccccaaaaaagagggctgcctctttgtccagaagagatgattcagggaccaaagctttacctccctgagggatctcattcagcctttcttccaggggccagacatgcataactaaaacccaaacctttatgatttggagaacgctgataaattacaaatgcaaatgggtaaccaggcaacagccccccccgcctgatgccaggctgggtatcagggctgggaaatagagcagaggtcacttcctcccacctggcacaggtcacgagagcctcaatgatgtgtcctttacaaagctgcttttatttagttggaagctgcttcagagacaactgtgaagacaaaaaaggttgctgtgtgtggtggctaagacatcagctgcatctgaggggctggattctgcaaggaaataaactatgaggcaagagaaaggctttagaagatcctccaactgttctcatcgttctgttagctggtctcctgatgaggttctgggtgagtctcaggggctgaggaggtgagttcaggcccctaggagaagaaggaggggggaaacatttcccttcccagtgtgggcctttctacacctacccctcatttacagcctgggatgaatccaccagggcggctgttcacacacaaccctgtcctgaccccgtcccaaccccgtgcgcaccacctcccacccaggagggtgcctaggtccccatgagtgcagggctgggtgggtgagggtttgaggcaggccctgagggccaggcccagggaggcaggatacccacagaggtggaaaccttaggctgactttatcttggctccagtgccggagctgttgaaaacgtggccccaaatgtgcacagaagtcagcagggtgaagggtgagctgccttgcctgctctgccatcaacatggaggcctggaagctttttgcagccctcaggaggggtcctggaaaacagtgcagacacccgtcccgccgggcctggaaaacaagcgagcaatcagctcagcctggccctagaaccacccacccaaactggccccaagccacagcacggacgatctggtgtgtagtgcttagatgccagcctcactcgaagatgagttgcaactggggctgcaattccaggagggcacccacaccttcacagctcagccccatcttgggctgagactagagcaactcaggcaggatggagccagccccaccagcggctgcttggtatccaggcctaaactgggcaaagggcggctgcaggaccctgggcagggcccaggacggatgggtgggcaggagggtgggggcccatctctaagccggaaggagaagcttccagacatgattgcatctgaccttctcctagcgtctcctctctctggctcagggcccactgtgagctcagctccgcactcctgggtttcatcctggggaactttgtaaagtatccaatctacagaaaattgccaacctctggaagcctcagcaggaccaatgtcctccatgcagagcccttcttatcccctaggaccgcaggcccaggctcctctgggggtcagggcggggcacagctaggagggaaggggagttgctctgggtaagtaagatgcttctaagcttctaaatcaggttccagagagacccccacccctgatcccccaccccctgctggcctggagcactgaggtcttccaaaccttccagaacattctcagctgagcactcccagccctgggcaaatcccaagggaacctggaaaaggaagcccctccccttgctgggattatcgtacccttatgcttaaagggccagagggagaagaatgtttctgtgctttttagagaaactctctccacaaaacacttcctgatgcttgtctgacaccaaaaatctattaaagtcataaagttctcctgcagaacgcttctcaaaaatgtatttatctaaagggcatctgtgtttggtctccaacgcaaacgctccaaatgtcgggccccgggtgatttatttgggcgccttgttctctccctgcgagttgttttcagctcaagcccctggttgcgtcgctccttcccctgatgtttatagatggcttccatccgctcagagccaggccggccaggaagaaggggcttggaggagcaggtgagcgtgcatcaaggggctgcagagagtggggcagcggacagatgctcccagcagacccctgcactccccacctgctggctgagcacactcctggctgtcctccctgcccagagggcattctcctggcagacatttgaacagcagctaggaatcctcaccaggtccccagctgccctagatgctgggagttcagcagtcaacgcacctgaacccacgcaggcagacggggaacatgagacagaccaggaacagacaacaatgaagagtgatgcagggagtctggggccacagacattgcaaggccttcctcaggccacagggaaatgcagcacagctagggcgctaggctccatgcagcgccagtgccaagcatctaagcagggtgggaagaggtgacttctgagtgatgagtaggagttggacaacagaggggctgggaggagccaggaagatcctcccaggcaggtgggggtccaggacagggaacacctgggagtctgagggatggggagtctggggcagaggagagagggctggatgctgaggtcccagcattagtgatcaggcctgggcctctggctgcatacagagtcccctgacagctcttcatcagcctcttaatacgcagtagctcatcagcccctttccaaagaggcccctgagggcagggctctgccaaggctgagctgtgtctgtgctcctagccatgcctgctgtaggaaggaagtcctggggctgggcctggagggaagcagaagactctccagatagggggtgcccagggtgtacccctgcagtgccgcccgtctcctcagggctgtgcattttcaagctgcctggaagccagggcccagagggaatgctgcaagagcagagttccctggaacaattcaaccggctgcttctctgctctccttccagcagggaggtgggtggcaggagcccatcttccccaggcacccccaaggagaggctacggagatgttttttagagctgcattgctcaataagtatcctggccacatgtgaatatttaattttacattatcttaaattcaataaaattaaacattcagttcctcagtcacactagccacattttaagtgctcaggcagcacaaagttcaacatggtcatcgtcgcagaaccttcccctggacagacagagcaagcagggaggggcctctctggtttgtatgaggggtccaggcatggcgggaagccctgggcaggcctcagctcaggtagcagcacagggtagtgcaggggctggaggggaagtcctgagggctctgcctgcaaccagccccagggcttccaaagcaacaaaggcctgcgggagagccggaaggggtaccaagtgcctgggcccagtgcagtacctgagcaagtaccaagtgcctggaccctctgtagacacaggggctggaaaccacgcacgacctgcaccctgcaccccacacccaagggcaagcaggagggaggaaaggaaggtggccggcaggcagcttacagttccctcctgtccctgcagctcacagcagctcccgagtgtggagcaaggcaggctcccctgtgcacccacaggcctggagggccctggcagatacacaccttgccagagccacagccacctccatcctgggcccatggcagcctgcagacaccactggggcattcagtcactggcttcctgtttgtcagcatcccaaagcaccacagggttttttggctccaaaagacctcctgggccaaagtgagcctctgaaggtcctgcgggcaggacacctctcagaggacggagggcgcactgcaacttccagggaggccagccagaggctgctgagaggatgctctccgggaagggtgaatgcctgcctgttcctgctggggcactgcggggaagccaaggttggctggcctcccaccacctcccggtgtctccagggcagcactgtcccccagcaccatcttctttgcccaaggtcagctcccggggccgcccaggcctgacaaccatcacctacatctcttctgccttggacccctgcacacatgccttgagtttgggagactgtcccctagatgtacggggaatggagggacttggttttctccactgcaacgtctctgtttccaaaaatggtgcctggaatatagcaagggcccaggagatatctgtcaaataaataagtgggcttttcaagaaggacgaagggcaattgtgcagactgggggaaagagagattctcctaccagtgttggagcaaaaaacaaatcctcagtggtcattttgggtttggcgactgaagaggagaaatgctgagaacactgggagcaggcgggggcacacttcctccctggaaccccgctgaatggcagctcatggtggccttggatgccagggttcctccttcgaagtggctcctctgtggcccttctgtagcccctccagctcagacctggttgtagttgagaagcccaaggagaagttgtaaataggttttgcaatggcaatggtgagcttaatttttcattgaccttacctccagctaataacgaatcggggggcgctctttcactcacagaagcaaaaaggaaaagaaagggcttcctagtgacgagataatttgtcagaaagttatgagtgggcacggcagggctgtataggaagtgtgtattgaacaatacgacacactggcttctaattgctgctgcctttctgatcaataatacatgttttcaaaaagccttctgcttgcatttacacaatggactgtaactactgcaaagatccattaaggcctattttaaaaagcgcattcgtaaaaagttgtctaaatctgcattacaaggcagattatgaaactgccttgggagatgttttgtctaaaaagcattcagcctgtatctgctggacagctgactcgagcttccactctccacgttgcttggagccaggatgccttctccagaggatgcaccaagcaaggcaccggcaggcctgaggtcctgtccacagaccagccggcctctgagcccctcgggctggggctgccttatgtgagccaatcccccaggagcctgggtggccgcagacattaatcaacccaccactcccgaatgtgtaattcaaggtcagataagtggtcctctgcggcaaataggactctggggacccaggtccctccagcactgagaaggcttctggttgcatggggagggctcaaagcctgtggccaagccaggatgcagaagacaggtgtgtgctctagcaagccagtctcgttgaccaccagccccacacagcacacaggtgcgtgctgtcacctgtgcaggtgggaagcccggactgtttgggtccagggccccctggctttctatgccaccctagcaccatccagtgactgcttgggcctcatggcctcagctcctacagctgacaggacagaggctgatgacagcggcagctcgtgctgatggccagcgtccctgggctaaggactctgtgcagactgactgtctgcatccccggggaacttggggagaaggagctctgccttcccactgaggcacggagactctgggtaacccgccaaggacatggggacaagagacagagcgcagacacactcagagccccctgcagccttcccaccatgctactgccccaggccacacctagacagccccctgtaggagagaaaaccctggcagaggggcaggaaacactgccactgtctgctgagcccactgatgcatcattgggctttaccctcaaggcagtgcccatgttattgctctcatgtcacagaggatgacaccgaggcccagagaggaccacagaagctgctgagtggtgtggctagcctggctctggtgctgagcgaaaaggatggagattcctccaagggaaggggaggagaagacgggcagaggggaaagaagaaaggagggcgagggaaggaaattcacaagagaacaaagtgtggggacatggaaaactgaagtgggcaaagtgataatgataggttagtgggagtaggtgggcaggctggtgggaggaggtgggctttctctgaaccccccagggtctctgatggatatgtaggcccctgttgcttttgttcgggcacccggctcctaatcaggccccagggaggatgcaaaaggggtcttctcccaggccaggttgagggctcttctgcaaacacccctgagggcacctgaggcccacaggcaggcaggacctgcacagttaggtaaagcctgtcctgcacagccacaccctgcaggcccaggccaggtgttctgtgagcatgctcatggaagcagcatatttggcatagggtgggctggctgagcagcccctctgagtgccctgagagctagctggtggtcactggcttcctcctcgcagctgccctggagggcaccaacagcaaggccagggaggcaaaccgtggggagcagtagacctgcccctcacctcaatagcccgatgggggagcagagggcagtggcagacagatgggaaactgaggcaccgaccactttgctaacagtgcacacagccagcctcagagtctgtgcttccaaccaccatgtcacactgcccatgggagggacctggacccctgcccacgcccactctgagaggcctcggtcagcagttccaggaatgccacccagccttccagtatcaccaggaccgagctgcgctcttgaatgtgtttccccctacctgcaagtcacgaggcacccccagagccagagtttcctgtcactgcactcagcctcactccaaccatgcttctcagtgcaggcagagacccccatgtcacctgggtcagaggacacagagcatcccgcccgcctcccgccaggcaaacctgcacaggcatggcccagatctctgtccatgatgggtttccctcctccctcccttccctgtgctgcgttttggtgctttggggtcagacctgaggtgctccaggtaatcttcacctgctcagaagcaatgaatgacctccaagttctcacatgctacaggaagatggtgtgagccgcctgcccactgagcatcttaccctgcactggggcagagccttgaaaataccatctcctcacagtcaccagggaaggacactgtttcagtccccatttgagagatgacaaaactgaagctgaggagtaatgtatgcaatgtcacacaactatgaatggcaaaattcaaactcaggtctaatcactccaagcagatgcctgcaccagaacctcttggggaatttttttttttttcttagagatagcgtctcactgtgctgcccaggctggtctcgaactcctggcctcaagtgatcttcttgccttggcctcccaaagtactgggattacaggtgtgagcccttagcctggcccctgaactttttttttaacatggatttttagggagtgggggacccaggatgtgtgtcttcataaaagctgccctgaagattctccaaggggacctgcgggcagggacaggaagcactgaccacactgtgatgtgccctcctccagctcccagagagcccgcgaccctcagcagggcagtgtggccagggtgcccgagcccaggcccaggaaggcccaatggctacaacttattaagggcttcctgtttgtcgggcactgggctctaccctcacatgcacccctctttctagtttcaccccttcttctgaaagggagatgtttatagctggggaaactgaggctcagagagatgactaaggggagtcaagaaagagaggcagagccccctgcaggccctccccaccccatggactgagagaagccagggccaggactcctgggcagccaaagaccggcacgtctgctttgcacttcacctggcccccacctccccttgtgagacctcagggggtggcctcgcttcccctctgctgggcaaggagctccttcctgctgcctgatgttctggatactgagcctacacccaggcagggctgaatctcctttccccgcagtccctgaggccagcaggctctgggcctcacaactgtcctctgctgagcgaccctttggtcagatccctgggcgtgcacgtagcagggaggtatgcatctgtgtgcgtgtgtgtccacgtatgggaacacaggtgtatgcatgtatgcatgtgtacagggtacacccatgtgagggccccccagacctttttccaaggagtaaatgacaccctctcatagtgtcaggtgttcactcaggacccccaagggtgagggtggagcgagagcgtggaaaggcctaaggtaggctaggcaggagcacagccccagatggccccttaagatggccacacagagcccagccagacatcaatgtcagccaagggctggccagggtggtccccgggaggtgcaggggtggggctatttaagcctacccacttctctcttcattcacctaggaggcaatcacaggagcttgtctgtagccaaaagatgcccccagcccctccctacctatcaggtcccttccctgggcacaggcctgagtgtgtagcctaggtagccactggcaccagagatggaacctgtctgaacccaagggagccccttgtggccaactctagctccataaactggaagggtgtggcaggcagccggagtccagtggcccacagtgtctctcctgggctggcaggcctgtgccccggccacctgcccctcagcaagccaggtctggacatcacggttggctgagtgcaagccagcctctgtcttggcagctccccctcctgcctgtgagggtgacttcactttgacttcatatctgcagtgatgtgcagatcacttattcagccctgagctcagccaggcaagagggcggggttctgcacacagcaagcaagggagcggctggctcaagggtgccctgggcccaggttccctggcttttcctcctcaagggcccatgggcttcccttcttccatccctctgcgcctaagtgcaggccagacctcaaaaagcagccggggatggggcgagaacagaggacttccccactgagcccacatccaacctcacccagaaccccttctcaggtccagttgctgctccctattaggggtaaatgtgtttatgcgcatcatttccatcatttctttgggggaaaattggattctttcctcctcctcgctactcgctctccgactctgccagcccatctcctgagagttctcctgtgtaagggatgcaagggccaccagcaccaggtctctgaaaggacgccggagccagtttccggtttccaagggttggaccagtgctggaggggggaatcacaaactgcccttccaggaccctaccctctctactaccccaggatgctgaaaaaggctattctgcctctcttcccctgctcagctcttccccgcctcctgcctccggccccagcagaggccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtgtaaactttttttctttttaacattctagttggaaacaacagatttctgattttgtagtttccatacaatatttaaaacatcacaaagaattctatcatgataaccactgaggcatcaatagtggtcgaggactaggggctctggagatatcgctggcttatctggtacatttgcgtgtgaataggcacattgatagaaactgaaaaactcagctaactccactgttcaaggaatcccttccttaaaagtgtccatccctagaacaaagcagcagccagtgtcaagtttaggtcttcacagttctctagcaatttgcttgttgctgatcttttgaagttggccttagagctgtgggagacagaatacaaaatgccaagtcctgaggaaggccattagaagtgtgagggaaaatgctgtcctgaaccaccatgaagcctgacatactcactacttctgtttatgtcttccccgaggaattctctgagcttctcatgccgggcgtggagctgatgggtcagtgggcaaacgggagttgttgtcaacatcagtctcatctgcgattgcattgtgtcagatgccaacggcctgtgtcacacacatacacgtgtgtatacgtgggcctttgcacgcctcgccaggtggtgtacatgcaggccttggcacgcctcgcccagtgcccgccccaggcccatgaggccccgcttcccagccgtgggtgtctgtgtctgctcacggcttcctccttcagcctggaccacgggctggaagtgaacgtaatctccagagccagctgtttgctgtagcctttacctctgaaagtagaaatctacgccaagaaaagttaatgctaaaagccacccctaatgtagactctacattaggactatttgtgtgtgtatgtttgctgttttattttcccctaaaaacacattttctgccaaccttcacgaaggatttcttcccaccacgaggccagcttatgtgggcagaaatctagttgaatgtgcctgagaacagggcttgaacaaatacttcatacacaaaagaaattttgaagggaaagcataatttctaacatataaagaaagcctctcccgcaggcaggtggagcagttagcggtgcctctctctgcctcgggtgcgttcacgcatagtgtctggcacaccttgttttattgctctttgctttattgcgtttttcacaaattgaagttttgtggcaacgctgagtcgtcgagaaagtctatcagggccattcttccaacagcccacactcacttcatgtctctctatcagtactgttaagcagtaaagaatctttaaaccaaggtatgtacattgttttttagacatagttctgtcacacacttaacagactccagtacagtgtaaagtgtaacttttatatgcactgggaaaccaagagacttgtgtggctcacttatttgggatcttcaatcttctttgctttaccggagtggtctggaacagtatctctgaggttcgcctgtgtttagtggtcctcacaactggggggtggttctaggaagtcctagggaatcctaacctctgtggccctgaaaaagcagaaaggtgggtcttcagggtgcatgcagcagtgtgcgtggccccacacgtcttccacatgaagatgctccaggtgcaagtcctaggcttgtgcgcctgcagggaaagcaccctctctgccagggctcctgctgtggccctgtcccttctccatggcagcagccttgaccgaaactgtgtagagtctcccacctcttcagggagctgggactcaggaaggatcatcttagctgaggtcataagaacctgcatgtagagaacttttcagcgtggggccactactgtgtcctgctgctgaggccaggtagtggccgtctgagggctgcaagggcaggctgctcccaggagttaaggaggcaaacactctgaacaccctggagaaatcacagtttatctttgcaactacaaatttgagtgctgtgtcaagtgaccaggtatttttgcagatgtctctgaggtgttaaatcacaggacctggccaagcaagatctctcagctggaccccgggcaggggatcctttatgggggcacatctcactgtgggggctgcagaaatgtgaaggtcatcatggagggagcttgcggtctgaaactaccccagccactgtgactaccacactgggagagatcatagacctgcatcctctcagatgacactgagcagttcaagctaaaaatgtgctggtaagcaaggtaagtgaattctaaagctaaaaaaaatcatttttcattttctgagaaggaaacaagtttgatatttcatacacagacaatatttaccatgcagactgtcaatttcttgaataaaaatatgaaattcatttaaaacattcaagtttttgtgtatttttctcaatgtattaacagaagagcaacctgtttcttggctgctcgattgtctcacctgcacatcaatccttttctatactctcccatggaagaaggggtctccaggggcaagagactttggtcagaggactgcagggagccaggcagcacccatgtcttggagcctcccctctccctagggcgtgtgccttgctccatattttgtgcctttcttctgggagttttcaagagcttgagaattttcctggagactctggccacagggcctgaagctcttagattgctcagaaccccatggtaaaggagcacactgagggtttgggggacttcagtgtctgggaagaaaagtaagatcatagcaaatgatttctaaaaataagaatgacaccaaggatggaagagctgtagtgtctcacaagacagtcactggaaaaagtagaggaagtgtggttggacactatttttaaagagatattcacacaattacctctaatctttaactttgtagaaataagcaaaggctacccatatgagaacccacaggagccactggttctgaacttgctatagcaagagagtcagccaggatcacttacttttggcagacactcaaaagcaggcagaggagtgggaaagccttatagtaaaaaataaaaggtggggagggtgaggagaagccttcagggatgctgtgattggggcttgttggcctggggaagctggaggcagctaaccaggaggagggcctcttatgtgattggtttgggggacacaggtggctttctctgtttagttcagtgggcaaaaaatagggaagcttgcagttcctgaccaagtcctaaccattctgggataattgttacagaggctgtggtttggcttcctggctagttctgcagagaatctgattcaaatcctctggccgtatgtggtctggccattgtctgtttgcatgttcagtctcttagtcccccttgtcggtcattttcttgtttgtaaaaggttggccaactcaaggaagtctagagatccagctcttcactgctcagagattattcagttgtctctctggtcaaccgtattgtgagatcttgatccttctgttgttatagcatcacagtgctcatttgacaagaatgggatgcagtggaacaacatcaggaccactatgacagaaacaagagcaactgtccctgtgagacgctttgaacgcaaacctcagctgaccaatgcaggccaagagcaaatcccatataggccatgaggatcaaccttagaaagccaaatagcttttgcctcaaggtgatgtgtgacctgttctaccttctcttgtttcactgatccagatgcagtattagcagtggcagaggccatcaccaaccaacaagaaatctacagcaatgagactgtccatcactactcatgccaatgagttgagactgataggtgccccatctagggaagaaggggcattgctaatgacttctgccagggttaatgataagtttatgacaacaggattcccacagatgagaacattgctctgattgtttgcataaacaatgagtcagtaactccccagttagagtgctgaataaccaagggtgatgttacggtttttgcagttttacaccaaccggtttgtggtaaatcgttacagcaaccctaggaaaaccaacgcaccatttctatgtatggttaatgcatggcaggtgtttaaaggtattgcaggatattggtgcttttcctttccccagtgcacctcattgatctcaagtgagggatttttctttttgtcttgatttttgttttctaagttgaacaatctttttttctcagtgtcctttctgtatacagtatctataagtgcccttgtcagtagctgactggttggggaggggctacccagctgtttgatcagcagggccacaagttaattttaggtcctgtcttatttttgttctaaagcacttttaaaatgtctgccaggtgttgtagttcaggttaaggggctatttcccattctcatttctgtttttgattaggtctccgatttcagatttagctccttgacaacaagcaatgaaagggccactttctagactcccaaatgatacaatgtattttctagcctatcccaaaaaaaactcctgcaggtccttttgtttgtttgtttgtttttgcatgacaagggattatggtctaatctttttggtggggggaatgtttgagatatggcttttagaagactttgccctatgttttgagcctctttgttaactcttcagttttattgtggacagtgggatcctaggatcccttttgggggagtctagtcaacttttgccattcaggatttagcatgcaaggttctggtcaatgtgtacaagttgatatgggttaggtaacactgggtcacatgcttccccccgccgctttgcgatagggtcttgctctgccaccaaggctagagtgcccgtggtgcaatcatggctcactgcagcctcaacctcctgggcgcaagtgatcctcccatctagcctcttgagtagctaggactacaggcacacaccaccatgcctgggtttttttttccatagagatggagatctcactatgttgctcatgctggtctaacttgtaggctcaggcagtcctcactgattcaccttccaaaatgatgggattacaggtgtgagccatagtgcctgaccaaagtattcttaattattttatgcatagttgctgatcttgcctgggtttggggaaatccttaattatggttattaatttagcttgggtctaaggtttaaattccacagttgtctgtatatggggctcatggaggaataggccttcagagaggcagctggcatcctggggtcataggagggttgttgtgaaagggcagggatctggacaagaggaagagaagtgtggacagatgtgtggaagggaagagatcagaaggataagggggagaagagggagagctgtattagggaagcaaatggatgataagcagaaggatttactaggaaaatgagtctaggttgttgctgcttaagtttgccaaatcgctcatcagctttagccagagtctttcagggaagcactttttgaatcagaatatcatttggagacctctgactaccaatcaaaaaaggctgctcattgggcctaagaaatcttattctctttcgtttctaaggcatctctcaaatgagcaattttgttcaagttagatgttctccaaataagatcttcaccaaatcaaccttggtgaagttaatgcttttcagagatgggcgtaaggattagaattgttagagagtatatgtaagaagcaggagttttttctggaggaggagatttaaacttagacaacaccatgaatgctggctggtgaggctggcgagaaatggaatgtttgtgtctctcaggacatgaaagcgagacggaaggagaacctcattcagttttactggaaacccacagcaaagtttctccaagtagaggccggtgtgatgagaactgctaaatcatgagctgcgaggctggctcaaacaagaggcttatgagccccatgcctgtgtcctttcctacggttttccttcttatgacaagcagcactttttgacagcacaacactaaacactaacacaaaatacagtgaaaagggataaaaagaatggcctgattccactagagatgccagacaaatgagaatcaataacaaaaccagagtaccaaactgagaataaatagccagagacctccacgcagagtgaggtgagccctagtgctgaccacatcggcgcacctgataggccgagaacatggaggcatgaggggcctctgggtggcacaatgggtggaagcctggggacctcagggacaagcagtacagacttaccatgggatcaccaggaaaactgtggaaaccagcaaaggctatttattcacaacttgctatagcaggggaatcagccagcatcacttacttttggtagaaatttaaaaggcccgaaagagatgggaaacttttattgttttgttttgtttaagtatcagattggaaattattggcaggaaatgtttttaattacatttttctgatattaaacccaacacagttgtactttaatattttccctaggagaactacttattttacaactatatcccagtgtatcacccatgatcagccacataatttgaatcatgcattatcttctctccacattcaaattacatacatttagtatttggctacttaaaaaaaaatcattaaaaagtaacaatttaaatccattgatgggagaacctcagttagtttcaaaacaacaattcttgccaggcggggtgactcacgcctgtaatgccagcactttgggaggccgaagctggaagatcgcttgagcccaggagttcaaggccagcctaggcaacagagggaggccccatctctaccaaaaaaaatattaacaattagccgggcatggtggcatgcacctgtggtcccagctactcgggaggctgaggcgagaggatcgctggagtcggaggtggggaggctgcagtgaaccgtgatcgctccactgcactccagcctgggcgacagagcgggaccctgtctcaaaaaatagatgaataaataaataaaaacaattataatggaagtttggataggaatttaaaacatgtggcaactaaccctgaccctgcggcttcagtctccccgccgctagctgagggccgtggccgctgcacagaggcttgtgaggattcgggggttcaggcagcgcccgccgcgcatctgccagacgtgcggccacagggtaggagcagtaagaaggatccagggaaaaaagtccacgaatgagaaaggaaacccagcgtttgtagggctaggagaacaaagaaagaaaatgctggcggcggagggcgaggctctgcggtgcgtggcagatgggaatttgctcggtggcggctcctctttctggagagcttcccagcgtcccctcccccgccagcccgcggtgacgcgcccggcacccaccacagccggctctcggcgccgtcgcgccttcgctcgcccgcttaggccgtgctcgcggtggcgtgggagacagagagcccagggaggaccctggaacatgcagtggtatggaagacgcctaagaaagggcttctctttccactcacgaaaatcagtgtgtgagctcgaagccatttcccagcgtgtccgcctcaactccctcattcaacagatgaggaattcctccagggaaatgcagtgatgcgctcacggctgccggcggcccagcgccaaggggcgctccacagccccgcggcccgaagccctcgactcggctgccacgcaggccccgcggccccgctcggactcccaggatcggcttccgagcgggacagcgctgcagtccacgagtccgggcaggggcgcctccaggccggagcggtttcctgcctcgggcactctgctgtctccacaaacggtttttggaggcacacacacggatactttaaacacgtcggtgatgaatcggtacccagctgccagtggcggagcttcctgggcggggccgcgggcgcgcggcggcttcatttcctcgcgcgcgccggaagtggcctctcaggcgcggcggcgcgcccgggggtgggtggctgaggcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaatgtgataaatttatttctattgtaaagtatcataaagacagaacattacgtataacatgtaattgtgtactttaaaaatgaaacacgagtgccgcagctgttcacgttaaaatatggggcattaccaggggacaggccccttgtgccccttcttgatcacctgtgctcaccctctccataacagtcacactctgatttttatgatcgtttttacttgtttttcttcttagttttcccagttacgtatctcccaatagactgttttgcctggttttgaatttatatacattattatttcattatatattctctttcattcagtgtttttgaggttcactcatattattctcaaaattagttcatttttattattgagtagtatttcattgtactgtagggaggggaaaaactccctcccatcttctcagggtcccagctggccttgaagattaaattggcataggatagattaacaagagaaaagcatataaattgatgtaatacaaattttatgtggtgcaggagccctcataaagaaataaaaccaaaagaagtagagtcagttacttacatactgaattggacaaagactagtaaactgtgaaaatgtgactgtattttgcgggagccttaaaaaatagttattctaacaaggtctgtacaatattctcctggtctcaaacttctcgtcattgaagataaagatgtttgttgccttttcttccagtatagagagtgtctttcacactggaatccatctcctgctcttaagaaacagcacaaaggtcaatcacctttttgcacctgctgtttttcatgtgtctttaatttaaatagtatgccggaatggcatattttaaccccttcagtatgaatgtactactatacttcttctactgttactagatacttgggttgtttccaagttgtttttatattctcttgttggtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtggaccaccttccaccactgggtgagttcattttgcatccttgacagtacttaattttgtcaggcttattaattcttgccaatttagtgggctttaggcatgaactgtagttatgatttatctccagtctttttgttcatttttaccagttcacagggattcttcacatattccggataccagttcttgttggtttaatgtttgcagatatcttctcccatcaagaccaatgtggtttgtcttttcccatttttggtggtactttttgataaataaaaaactaactttattgtgactatcttttttctttatgatttctacttttttcaatagaatttattttttagagcaattttaggttcacagaaaaattgaacagaaggtacgtggagtttccttagatccccctgcccacacacatgcacagttttttctgttacctacatctgtcaccacagtggtacatttgttacaaccagtgaacccacattgacacaaaataatcacctaaagtccatagtttatgttagggttcattcttgttgtacattctatgggtttagacaaatgtataatgacatccagtgttacagtatgatacagaacagtctcactgccccaaaaatcctctaggctgactattcatctctccctaccctctaacctctagcaaccactgatgttttcactgtctccatagttttgctttttccagaatgtcatatagttggaatcgtacagtatgtagccttttcagattgccttcttatcttagtagtatgcatttaagtttcttccatgcctttttatggcttgagagctcatttctttttagtaatgaataatatttcattgtctggatgtaaccacagtttacccattcacctactgaagggtatcttggttgcttccaaatgttggcaattattaataaaactgcaataaacatctacgtgcaggtttttgtgtggacatgttttcaacctttgaacaaataacaaggaacacagttgctggatcatatgataagagtatgtttagcttattagctttgtaggagcgtgccaaactgtcttccaatgtggctgtaccattttgcattcccaccagcagtgaatgagagttcctgttgctccacatccttgcaaccatttggtgttgtcagtgtttcaattctggccattctgtaggtgcatagtagtatctcgttgttttactttacatttacctaatgacatatgatgtggagcatctcttcatgtgcttattttccatctgtatatcttctttttttttttttgagacaaggtctcacactgttgcccaggaggctagaggctggaatgcagtggcgctatcatggctcactgcagcctcgacctcctgggctcaggtgatcctcctgcctcacctcctgagtagctgagaccacaggcatgcaccacctgccctggctagtttttttttgttttttttaatagaaacagaggtccccctatttacccaggctgatctcaaactcctaggctcaagcaatgtgtatcttcttctcaagtgatgtgtattttctttaatgaggaattggtttctactttttattgatttatgacctcataatagggaaggatttctttaaaaatactgttgtatattctcaatatctcccatgtaatttcacttttctcaggtctttaacctaagtggaagagatttttgtgtatgatgtaggtaaggattgcatttcacttacttccagcactacatccatactttacctactgatctgcaaaaccattcttatatccatcagatgtccctgtgtgcatgagtctgattctatgctctcttctgttccgttaggctaccactctatcactgcaccattagcattgcatggtatcagttactgtaattttatgctagtgaatatctgggacacattttccactcaccttgttcttaaagatcgttatggctatcataggctttgtactttcatataaattttagaatacgcttattaggtttcataaaaatgtatgaatttgattagaatatcattgaatctgtaagatcactttggggagtctttatgatatgaagtctcccaatctattctatttggctttattgtttttcaattacattttataatttttcacactgtggacttacacatgctgtttttcagattcttcatagttactctgcatttttgataccattgtaccttatcttttattgtgttactggtgtttagaaatcattgattttgcatgttaatttttgtgttcagaaactttgccaaaaactgttaattctagtaattagaattcttttgcatttttcttgttttacatcatatcatacatatgaatagtgagttttgtttcctttccatttttaggtctttagttctttttcttgtcctcctatgcttggtaggatttgttgtgcaatgctgatggaagtggtaatagtgggctccctgccctgtttctgatttcaagcagtgctttcagggtttcatcagtaagtgtgatgtttgctggaggtgttttcgtagacaaccctgtcaacttaagaaacttcccttctgttattacttagtgagtttttatcctacctaagagcatttatcagatacttttactacatctgttgagatgttcatatactttttcccctcttttaaagtattaaattgatgaattaatagattttctcaagtagctttgcattcttgggacaaatgccagtcagtcatgatgtgttatttttattttacattgtttgatttggtttgctttcatatacatacatgtaagtattcacatttacacatctcatatgtattcatgtcgggggtgtgggtatgtatatacttcaggtgtttttaatctatgttcatgaatgagattgcctatgacttcccgttctcttccttgttgggcatttttgtttatttatttgttgttttaattgacgggatcttgctctgtctccaaggctggagtgcagtgggggcgatcatggctcactgcagcctcaacctcctgggcttaagtgatccccctacctcagcctcccaagtagctgggaccacaggcacacacccctgcacctgactcatttttgttgttgttgtttttgtttgtttgtgtgtagagacggggtcttggtttgttgtccaggctggtctcaagctcctggtttcaagtgatcttcccaccttggcctcccaaagtgcagagattacaggtgtgagccaccatgcctggccctcattaggcttttctgttgaggttatactagcttataaacttaagttacaagtgttccttcttactctgtttctagaaaagttttgtaaaattagaattaatttcttccttgaatattgaactgcctggaagaacggcctgaaagccacttgggcatgaacttttctatctaggaagatttttgatcagttgttcaatttatttaataattatagaactattcagactttctattgtttgtagaataagctttcattgagttattttgggtaaatcataattttctaggaatttatactgataaatttgaaaattcagatgaaatcaatatcctcctattatctgtgtgatatgtatacgatttatagtgatatcctttttttctcattcctgatatacttatgccttctattttttcttgatcagctttgccaggagcaggcagatttttttcaatccttttaaataacccttaccagccatgtatgagagatcagttgctttacctcctccccgacacagtatttccagtgtttttaatttaaactctttaattataatttctagtgggtgtgtacagttcttattttcatcttagtttataatcagggaatgatgtcaagtaccttatcatatgcttattggccatttagatatcttcttttgtgaaatgcctgttgaagtttttctgccttttttaaaaaaaattagtttgattttttttttagttgatttgtgggggttacttctgtattctgaatttgagtcctttgtcagatttacatattacacataccttctcctagcaacagcctctctttcactatgttaatggtatctgtcagtaaacaaaagttcttaatttcaataaaaaccaattttcttttatggttagtgattttggtgtccaatttaagaacctttcctactccagaattttttttaattctttttttgacacctcattgcattgcctttcatatttaggtctgtgatccatctggaaatcgttttgtatatgggttacaggaagagtcaagatccatcctttagtttttcttttagggaaggtctgtggatagcaaacgccatttagtttgtctgtaaatatctttattatctctcatttaataaatagttttaaaaagtagagaattctaaattggctatcattcttctttttagcacaatgaagttactattccactgtctcttggcttcagttatttctgctgtgaatcatcagcgtaacagccatcatccattgaaagcagtccactctcttcttttctgttctgtgtcactatgatacatctgcatgtgggtttgttttttttctggtcctgcttgagattcttcgggttccttggattgttactctgaaaaattctcagctgttttattttcaaaaatgattcctgcctcattgtctctttgcttctctaactctgataacatgttaaaaccgttgtgtcctccatgcctcaacctgtttcttgttttccaatgctttattctgtgttagattctgttaatttcttcagaattatgatcagatttggaaaataaccaaatagagcatctagaaatgaaaactacaataattgaattttttaaatccagcagatgggttgaacaaaattagacacagctaaggaggttttttttttttttttttgaggaggagtctcgctctgtcgcccaggctggagtgcagtggcgccatctctgctcactgcaagctccgcctcccgagttcacgccattctcctgcctcagcctcccgaatagctgggactacaggcacccgccaccacgtccggctaattttttgtatttttagtagagacggggtttcaccatgttagccaggatggtcttgatctcctgaactcatgatccgcccgcctcggcctcccaaatcctcccaaaggattacaggcgtgagccaccgcgccaggccctaaggaggtatttttttaaaaactggaatataagtcagaatgtttgtttctactggatgtttaggggcagtaccagttcagggccagttcaaagaattcttagcttgaagtttgttggaccagtgttgatttgtgctgcaaaattttgtgaagctcactgactcatcattatcaattatgaaggtaaaatttccctgcctccattcagtgctgagattcaaatcagggagcttttcctaggtccctcggtggggtttgggtggagcgccttatttcaagctcactgctgcaccgaggggtggctctttgggatgccagctttatgggctggggtctcctatttgattcttcatcttgaggtgggccctggacttttttctctacccctgtggacttgaaaacagcagctcatggtccttaccctcagggcaaagcaggctgcagagcttccctgacttctctggctccctgccttcacttggatttttaaattttgtacaactttatctgttgttttcagtgggcacgcacttcatctctcacactgccagaaatgcacaagtggcgcagtttactttcttacactcttccctgcactgttgctgaaccactcagccctgctgagcgcgcctgagcatctgcacctgagcatcctggtgctgtgggtagatacttgtggggtgttcagcagcccctcaccttcctcacagtatcctgacttccttgttgggaataaagattgaaattgtgttaacgtggtctaaactggcctgcagatggattgtaagttttgcttcttgaagttttgaatgcaaatttgtgggaattctttcccatttatatttttatgctggttggattgaacagtgactgttaggtgaacagtgacatgttaggtgaatgctaacatgcttcgtattgaccaggaccccaggtgttcctttgagaagggggcctttgcttcacttttcccaaaaggtgctgtggccttttgcagaagtgctgcttggcgtccgcagcaccagggccagtccatagcaagcaccgactgtgctgacaatgaaccaggtgcctgctctgtctgcctttgcttcttagaagcctttgcttcacttttcccaaaaggtgctgtggccttttgcagaagtgctgcttggcgtcctcggcaccaaggccagtctacagcgagcactgactgtgctgacaatgaaccaggtgcctgctctgtctgctaccacggccctgcaagagagccgtgatcagatgaaaaacatggaggctataaggtaaacagcttgtccaagcttctccagctgggggctgaaaccagctctcactccagtttccccggctccttgctccctccctgctgccttgtgcctccctgaggagcagggtctatgttctcgtatgggcgtggtcggtgtgtgtcacaagcagtgtgtgtcacagaagtctccatggcttactacagatccttagcttatcattctgctacatctgacactctgacatccatttgttcctgcaacgtttgtgaagggtgacactcagccatcacacagggatgtactggtcacaaggcacacagactatcacccaccgagtgcttctcacacgtactgtgtggcccagggattggactaggcccccaccgtattgccaattcaggaggtgtgtggagaggcctaagaatggacattcaaacaggttcccaaggacccacacttgaaagccactgccctggaggaactgcccatggcaggggatggccctcccagctcgaggttgtatccaaggccagagcaaattatgcactcccccttcttcagctgaggcagatgaacacttccaaaaataacttcttcaccaggaaattagggatgccattggatttaaagacctaaaaaatgtcattcactaaaagctcaagcatcatctccatgtccccatttgctccacagacacccgagcacctgtcctgcactgcccactgcatggggtggcaaggccccgaggcccagcttctgtccaacacgggcccctggctgtccaaattcacatcccaaattcagcccctgggtcacactagccacatcccagcagacaggacccacatatggttggcagctgctgtactggacagcacagatacaggacattcccttaccccagaaaggtttctgttgggtggcgctcacctcgtgggaatgatgacactgagcacatagtgaaagatgagctgagttatccctggggtgcagtccccaccctgtccaggcctgagaaccgtgggaatgggcaggttggaggagcagaggggagtaccatgtcctgttctggagccttagtttttttccttcaattcccgagctctcatgtgctcccccagtgaacccctcttctctgttgcgcttgagtataaaactcatgacaccaggagtggcccctccagacctgcattctgcaggctgccctgcaggatcgcgtccaggggctctccaacctcccctgcccccagagaggccatctgactcctctgcagtaacacagtccatacagcctggcttaactaggtatcctgaacttacttacttatgtgaccatgcaatacagcagccagtgacatctttttggagctcacaatgaggaaagcaggactgaacgtgcctcctatagcttctttcgagtctcaccttattcagtggaaagccctttgtcacacaaagtgttgccagctggagacaaaagtctcttgcccagtccctcctgggaaggccacagcaggcctggcagcctcaccctcctccctgccccaggggacccatgtctccggccagcagcaaggccaccccctcactgtacacacacagcaggcaagggaggggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgttacacttcaatcacatgaagaaaactgaaggagagaaaaataagagagaacatctgggccaggacaggtagaagctgtcggcacctcagggcctatctaggtctgctgtggccacgcctgagggaagaagggatgtggaggaagggacctgagcctccctccgctcatccccccaagaacaaaggcagagttggggcaaaccctgctccctcttctaaaaggcacagcctacagggtcaagcaatggcaagtgagaggcatccactggttttggaggatggaaggtggcctgaggcaggtgacagaccttgcagaacagagaagcaggagcccagtgccccacagggggctgatgaggaccacgccggtgctacagaggccctgatgaggctcagcccacaaggccttgggttccaggaggagggtcaagggacagaaaggccctggccccccaccctgccctgctgatgccacctcattactgggccacaccacacagtccaagagtttcgggtccaaaccctgaaggtgatggcgcatacctctctatcctctccagggcatgaagtggggcccgagatgccaattcacaagggtgctggcaaaacacgaagcaaaatgaaccaagccctcagtgagctccagaggctcctcagacagcccctgcctcctcaggggtccgagggctcacgctgtctgccagactcaagcctcctgcacacacagccacggtctgcagagaggcccctccaggctcctccaaggctggtcagtacccctgggcagaggccactgatggccctaatcaaaaccacacctaaacacacccacaggctccagggaaggttgtctggcagccaaccctgtcccttgggtcagtggggaacccctaagccttccagaatttccctcaggccataccattagtgctcccttttggagaataatattccatgcactgaatcactcatggctttaggcataaagcgtgaaggagggggtgaatgggagtcagctgagctttctgatgcgcaaggcaacatccttccaggcaccagcatacctgggcaggagcccaccggccacagcgtcaggcacacctctccccagtcgtctgagtcagagcctccacatctttgagaagctcatcaagataccatggtgtatttagcccttccacatcctattctgcctcctggggtccatgagtctttcctgaggctcttcctggggtcctgtgtccatgcgccttggccacccctcctcagccacactcagagaatccagggtttcaacaatgcagcagtgtggggaaggcaggaatgccaggctgggaggcttcctccagatggggctctcaaacctgaccacactgcccaggagcttgctaaaaaggcagtgccaaggcgccatcctcagagatccttcctgcccccattggtgtgtgggactcagtgctcagggaggcggcaccagttaaaactcggcttgggatgcagggcctctggtccaggggaagagagcccaccacactgagtgccagcctgccacatgcacaggggacagtggagaacgcatccagggatcggggggacacaaggcatgggatggggacacagcatcatgcccagcacaatgggacccaacaagggaggaggctgcagccacacaggcaggacgggttgagggccaagacagggcccgggaagtcacttccccgagatgaagcagatgatgaccaacagggacccctcccatcacaaggctctggatacccaccccatcacctgagcagagacctgcacaaagtgagacacagataatacccctgacaccccaatgagaaagagagaagagggacagcacatggaaatagggcagacccagccagaagcaaactacttcatggtgacaaaaagcttgcaagttaaagccttgagtcatcacttggcacctgtgaaatctgcaaaaataatgttaaaggtaatatagagtgtgagcttaagcgtcagggaaaagccagggtcactggcaggaaaaggagagaaatggacagcaggtatccccaagcacctccctggagcaaagacatggcagcaggcatcgtctagggcaccgcgcatccatgtgtgtttgtgtgaccttgtgtgcgcatgtatacatgtgcttgagtgtacatgtgtgcctgagcaggtgtgcgtatgcacatgtgtgctttctgcatgtgtgcataggcatgggtgtgtgtacatagttgcatgcatgcattacgagtatgcaggcctatgcatgtgtgcatgtctgcacctgcgcctataaaacagacaagcatccacataccaaaagtctaatcagggtgccttcctccactggccagcatacaccttctctccgtctctcgcgccctccctcctcctcttctctccatttagccttatcaagtgcttcccaagttctctccaattactatgaatggcttcatcacagcataacacagtacgtgctcatcttctaaaaccaggacatgaggcatccctgctcccactaagactgtgcaaagttaaggctggagcagcagtggcccactcagggctcgcccctccctcggagcccttcacaggctcctggagaagagagactcagaggagaccctgcctgagagctcacacctgagatcacctggtgtgtaggggacaagggggggatgcttaggaccataggggggtctcagggccagcctggccttgtgggagggtctcagggccagcctaaccttgtgagggtcttaagaccaggctggccttgtagggggtcttaggaccagcgtggccttgtggggagtctcaggaccagtctaacattgtagggtatctcaggaccagcctggccttatagagggtcttgggaccaggctaaccttgcagggaatcttgtgacaagcctagccttgttgggggtctcataaccagcctagccttatagaggatctcagggccagtgtggccttgtgagggggtcttggggccagcctgctctatggaaattggaggcaccagtcaaggagagaggcttctgtctccctgggtccttggtttccacccatccttggccagtaccttcactcctccccgaccccggaggctcctagtctgttctcctgcttcacctgccctccaatggagcccctggccatcatgggcccaggccccggagctgatccctgaccccactgttgtgcccctaactcccactctccccctcctcccctcccctcccccccacctccatttcccctcagcctctgccctctccagaccacagacacagtcctcctgaccccggctcctcctgagctgcctcccaacctctcttttcttcttacctacatttctagaaagagcagctgcatctgctattttgcagccaattctgcctcctccctccagtccctgctgtgctcatcagaggcaccaggctaacgcacggcgtgggttccaaccaagcccaggcctgaacgcactcatgccaggatgcctagctggctccgctctccccaaactcagctgctactcctcagggatcccacgacacccagccccatagaagtcccagggaccatcccagcatggccccagcacatagaccacagagcttctctgcctgaatgtcccaggaccgccatgtgatgtctcctctcccacagggaatagagccctgtcctgcagacactcaggcacaggcaaacagagacccagccattgtacctgtgggcggggatctgggctcagcacagcccacctgcccatcaggggagtgggccacacaggccaaggcggccaggcctgacgcaggtgtgcctgagacccgccttcaggaggattagccatcatagattgagacccgcctttggggggcggagggagggggggtgctgcagattgagacctgccttcaggagggtttgccatcacagagtaacacctgcccctcaggagggttagccatgtcgacttaaaggggtcttcaggggagttagccgtggctagtttatgtgtgcctacaggagggttagccgccgcagattgagacctgccttcgggggtgttgtatcgcagattgagacctgtcttcaggagggttagccatcgcagagtcagacctgccttcagcagggttagccatcgcagattgtctggtttcctacccttgagctgctcagtgtacttcaccgaactgcagtactttagatagctctactactaccgtttttgacagtttacttatatttcatttaagtttagtgggggaaagcctgggttccccagcctccttgttcactgccccagccccatgtccacatacactcctgcaactctgcaaagacaccagggtgctgtgagggtcccgtgggtttccccaggtcctcttttggcaggtccctataacatgttgcagggcaggggagaggctgtctgtgatgggcagggcccctgactgccattcgggcaagtggggatactgagggaccctgaaagatatcagggtcaggctggtagggcatgtgggcagcaatgcatctcagggagtcctgccccctcttccatgggaagggcccacagctgccatccccatgagccagagaggatgacactctaggctggtggaaagggacctgatatcaaatggaaatgaggcaacccacgaatacacaagtctgcacgtgcttctgtgcatgtgtctgttcctagagcagacacaaatgttccagaagtttctttcttagtcattcacagaatcacaggctctcgaagaaggggtattattcattctaatcagtggtgcctggaatgatgccctgtagtttctttacttgccccagacacctgcagctccctggagagagcccctcagctcctggcaactccatacgttctgtggcagctgcagggtattccactgggtaggtgggctgccacacatgtaagaggtcctctagcaaaagacaccaaggtgctttacagtctttggcaacgaaaaacactcctgcaatgggcattattgatgaaaagtttttattcaaatgtgtgaccacatataaaagatgaactcctaatacttgatgtgctgggtcaaaggttatgatcattgtaagtttaaagagacatcccagaagtgctttcaatagagtatagccaggtagtgaaaatggtggagtaaggacctccaaaaaccctctcttccataaacgcaacaagaaaaccagcaaaaaacaaaaaggtcagaatccacatttttagaacttccaaaattaactaaacgcttgcagaaatcttaggaggatttattcaaaaaacataactgaatctcagtaagaattgcaaattttatagcacttgaacttgccctagtcccatccctgactctctatcccaagtgccttgaaaagtaggaccccacattcatcatgaaaaccactggcgtagcagcccctggagggaaaacagcaatggaactctttcaaagcttcattctcagaaaactgtcattatttgacctgtccagtagttcccatggagaccccacttacaaggatgtctgtatttgacctgactcagaggtctcaagtacaaaaatcatattccccaaggttcattgtcaaaaacaattactggtatttaatttcacaaatgcctgaagcagtagataacagtgaagcaagcaatagactaaccagaaagcttaaaaggaaagtttcagtaatgacatgatcataggggttttgaaaaactgcagtgcattcctgagaatctagaaggtcaagtgcatgctcagggctgtgcacatgctcagaaaagtacttgggaaaccctaagcactcacttctggctgactttgagtctctgtgcaagcaggaagagaagactaaggcagagttatcagctgcttagctgagagctgaaagcatacccaaagacacagagccccttagcgaagactgagaactttattgactccaggcacttatgaaaatttctttccaatcattatttgaccgctaagataactgagcagagatttcagtgccacacacaaaagaatacagactttgcagaagtaatccagaaatgtcacaaaacaaacaaccattactacaataaacagcagcaacaacaaaccccaaagagtggggagaatctgatttccagaattgacttactaaacaaaaactttcaatcagctactttaagtatattttttaaagactgaaggaattgatgtttaaagaactaaaggaaagtatggaagcaatatatcaaacagagaatatcaataaaggaatacaaattataaaaaagaaccaagcagaaattctggtgttgaaaactaagtaaatgaaatgaaacatagcaagaggggctcaacaacaggtttgaacagagagaagaaagaatcagtgacttgaaaaaacgtccattgagattatccagtctgaggcacagaaagaaaaaagaaaggaacaaataaatagagccacagacaccataatggacactatcatatgtataagaagagtctcagaaaaagaggagagtgagaaataaggcagaaaaaaaatattagaagcaataatggctaaaattttctaagttagatgaaaatattcatctccatatcctaaaagttcaacaaactccaggtagatttcttatcaggaaccatgaagggcaggaagcagttgagctgacacgttcaaaatactgaaagaaaagaggtgtcaaccatgaattctttatgcagcaaaattgtcattcaaatatgaaagggaaattacctgacaaataaaatagagaactcgtcagaagaagacctgccttataagaactactaaagagagtccttcaggctgaaatagtaggacaataagcagcaacttgaaatcatgtgaaaaaataaagaggaccattaaaggtaactttactggttttatatttattgctatatattagtaaatataaaagatagtataaacacattttatgcacttaactctatttttctcctatttgaattaaaagacaactggtctatgaccatactaccctgaatgtgcctgaattaaaagacaactgcatgaaacaataattataagtatagattgatgagcacacaaggtataaaaatgtaaattttatggcagtaacagcacaaaggagaggagaggcaacagaactacagaggagcaaagtttttgaatactgttgcaattgagtttgtattaatctgaacattgacatgtacatataacatatacatagttatttgttaagatattaattataaccctacaggcaacaggtaagaaaataactcaaaaatatacaataaaggaaaagacagaaattaaaatggtacactagataatatctaaatatctatttaacacaaaagaagaaaataatgaaggaataaaggaacaaaaatggcataagacataaaaaacaaatagcaaatcctaccttatcagtatttacattaaatgtaaatgaattaaacactccagttaagagtcagagattatcagagttaaaaaaaaaaacatgatccaactacatggctttctaaaatagacccactttagagagaagaacacaaataagttgaaagtgaaaatatggccggatgcagaggctcacgcctgtaatcccagcactttgggaggctaaggtgggtggatcacgaggtcaggagattgagaccatgctggctaacacagtgaaaccccatctctactaaaaatacaaaaaaattagccaggcatggtggtgggcacctgtagtcccagctactcaggaggctgaggcaggagaatggcgtgaacccaggaggtggagcttgcagtgagccaagactgcgccactgcactccagcctagacgacagaacgagactccatctcaaaaaaataaataaataagaaagtgaaaatatgaaaaaagacattccaagcaaaaagtaatcaaaagagagccagaatggctatattaatattagagaaaatagactttaggacaaaaattgttactagagacaaagaaggatattttataatgattaaagggctaatcaacaagatataacaattacaaacaaatatatacctaacaacagagtcccaaaattcaagaagcaaaaactgatagaattgaaggaagaaataagacaattcaacaaaaatagttggggaattcaatagccccactttcaataatgaacaaaaactctagacagtaggtcagttaaaaaaaaatcgctccctctccctctccctctccctctctctccctctcgctctcgctctccgtctccctctttctaccgtctccctctcttgcagagcctggactgtactgccatgatctcggctcgctgcaacctccctgccttgggctccggtgattctcctgcctcggcctgccaagtgcctgggattccaggcacgcgccgccactcttgactggtttttgtatttttggtgcagacagggtttcgctgtgttgaccgggctggtttccagctcctggcctcgggtgatctgcccacctcggtctcccgaggtgctgggattgcagatggagtctcgctcactcattgctcaatgttgcccaggctggagtgcagtggcgtgatctcggctcactacaacctccacctcccagccgcctgccttggcctcccaaagtgctaagattacagcctctgcccgcccgccaccccgtctaggaagtgagcagcgtctctgcctggccgcccatcgtctgggatgtgaggagcccctctgcccgcccgacccatctgggaagtgagaagtgcctctgcccggccgccaccccatctagaaagtgaggagcgtctctgcctggccgcccatcgtctgggatgtgaggagcgcctcggcctggccgccccgtctgggaggaagtgaggagcgcctctgcctggccgcccccgtctgggaagtgaggagtgcttctgcccggccgccaccctgtctaggaagtgagaagtgtctctgcctggctgcccatcgtctgggatgtgaggagcccctcttcctggccgccccgtctgggaagtgaggagcgcctctgcccggccgccccatctgggaagtgggcgcctctgcccagctgccccgtccgggaggtgaggggagtctctgcctggccaccccgcctgggaagtgaggggcgtctctgcccggccaccccgcctgggaagtgaggggcgtctttacccggccgccaccccatctgggaagtgaggagcgcctctgcccggccgccccgcctgggaagtgggtgcctctgcccggccgccccgtctgggaggtgaggggcgcctctgcctggccgctgccccatctgggaggtgaggggcgtctctgcctggctgccccgcctgggaagtgaggagcgcctctgcccggccgctcttcgtctgggaggtggggagcacctctgcccagccgccccatctgggaagtgggcgcctctgcccggccgccccatctgggaggtgaggggcgtctctgcctggccgccctgtctgggaggtgaggagcacctctgcccggccacccagcctgggaagtgaggagcgcctctgccaggccgccccgtctgggaagtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtactaagaaaagttcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcatcaccgttccctaatctcaagtacccagggacacaaacagggccgaaggccgcagggacctctgcctaggaaaaccagagacctttgttctcgtgtttatctgctgaccttctctccactattatcctatgaccctgccacatccccctctctgagaaacacctaagaatgatcaataaatactaaaaataaaaaaattaaaaaaaaaaatcagaagacttgaacaacactttaagccaactagacctaacagacatcgacagaacactccacttaacaacaacagaacacatactcttctcaagtgcacaggaaatattctccagaatagaccttatgttaggccataaagcaaatctcaataaatttaaaaggactgaaattatacaaagtatgttctgtgaccacaataaaataacagaagtcaacggcaaaaacaatctgggaaatttacaaatatgtggaaattacacaacatattcttaaataaccaatggaaaaagaagaaaccacaagggaattctcaaatttacttaagtaaaaatactatgaaataaatggacatgaaaacataacatgccaaacttacggaatacagcaaaagcagtgctgagtttaaaaatatatatataaaactataaatgtccacattaaaaaacagaaagttctcaaatcaacaacctaacattccaccttgagaaactaggaaaagagaagcaaattaaattaacaaataacagaagaagaaaatactagagtgaaagtaaatgaaatagagagtaaaaaaaaattgagaaagttaatgaaaaaccaaaaatgggttctttgaaaaataaaactgacaaacttctaactacactgaacaagaaaaaaatagagagaagactcaaattagtaaaatcagagaggatattaccaccagctttacagaaataaaaagcactataagggaatactatgaacagctgtttgccaagaaattagataaactagatgaaatgggaaaattcctagagaaacacaaactctcagactgaaacttaggtcagaataaacctataacaagatattgaattagtaatcaaaaaacttcttgcccacaaagaaaagcccagggccaaagtcactggtgaattctgccaaacacttaaagaattaacaccaatcccttacaatgtccttcaaaaaatagaatacaaagcactaaccaattcattccatgaggtcactattgccttaatactcaaactaggaaacaaaatcacaaggaaaaaaactataaaccaatataaaccatccataaatgtagatgcaaaactcctcaacaaaatattagcaaatcagatccagcagcatattttgtaagtattcatcatgactaagccatacgtattcaaggaatgtaaggttagatcaacatacaaagatcaatgtaatataccatatccatagaccacataatcatcacaatagatgcagaaaaatcatttaataaaatccaacatcctttgaagatttaaaaaaatgctcaacaaacaagcaactgaagggaacttcatcaatccaataaaggatatctgtgaaaaatccagaacatcacagttaattgtagaagaccaaaagctttcctcctaagatcaaaaacaaaacaaatatgtctgctcttgcctcttctatttaacattgctctggaggttctggcctcggcaattggataagaaaaagatataaaagacacccatattgaaaagaagaagtaaaactatctctatttgcagatgatctcatatataggaagtcctaagaaatacacatacacacacagacacacacactattagaactaataaataaattcagcaaggctataggatacaagatcaatatatgaaaatcaattgtaattctatatggtagtaatgaacaatctgaaaataaaattaagaaaacaattcaattcgtaatagcatcaaagagaataaaataattataaatttaacaaaagtataagacttgtacactaaaaactacaaaacatagttgggagaaattaatgtagacttaaataagtggaaggacatcccatgttcatggattgtaagacaatattcttcagatggcaatactccccaaattgacctacagattcaatgcaatccctatcaaaattctagctggcttttgttgttgttgttgcacaaattgacaagctgttcctaaaattcgtgtgaaaatgaaagggacctggaacaaccaaaacagtcttgaaaaagaagtacaaagttggaggactcacatttcctgacttcaaaacttactacaaagctacagtaactaagactgtgtggtaatggcataaaaatagacctataaatcaacagaataaaggtgagagtccagaaataaacccacacctccatggtcactcaatttttgtccagagtgtcataataatctaatggggaaagaatactctcttcaacaaatagtgctgggacaagcagatagcctcaaacaaaggaacacatttggatttgtacctcgtaccacatataaaaatgaattccaatggatcaaagacataaatgcaagacctaaaactataaaactcttagaagaaaacaagtgtaaatctttgtgaccttgcattaggcaatagtttcgtaaatatgacaccaaaagcatgtgcagtcaaattttaaaagagataaattggacttgatccaatttgaaaaacttgtgcttcaaaggacactatcaagaagaaatgggaaacactaccctcagaatgggagaaaatatttgcatgccatatatgttatagggtctagtatccagaatatatgaagaactcttacaattcaatgataaaaagatagcccagttaaaaacgggcaaaggccctcatggacatttctctaaagaagatgtacaaatggccaataggcacattaaaatttctcaaaattattagttattaggatttcaaatgcaaatcaaaaccacaaggagacactatctactggggtggatataatagaaaagacagtaataacaagtgttactgaggatgctgagaaactgaaactctcatactttgctggtaaggatgtaaaattgtgcaatctattcagaaaatgatcggtatagttccttaaattgttaaacagagttatcataggacccaacaattccgctccttgtattccacaaaatatttaaaaacctctgtccacacaaaaacttgtgcacaaatgttcacagcagcattcttcatattagccacaaagtggaaacaacccaaatatccattaactaatgagtgtggtttatccatatgatggaatattacacagcaataagaaggaatgaaataccaacatgctacaacactgaagaacttgagaacagtatgctaagagaaggaaatctgacaaaaaaggccatgttgcatgattccacttattcaaatatccagaataggcaaattcatagagtcataaaatagattagtggttaccagaagctggtgggttggggaaggggcagtttgagggataattaagaagttctgggctgggcgtggtggctcacacctataatcccagcactttgggaggcctaggcagacagatcacctgaggtcaggagttcaagaccagtctggccaacatggtgaaaccccgtctctactaaaactacaaaaaaattagccagccatggtggcacacacctgtaatcccagcactttgggaggctgaggtgggaggatcacttgagctcaggagtttgagaccagcctgagcaatatagtaagaccccccatttctatttataaaaaataagattaaaaaaaaaaaaaaaacatggccgagtgtggtagctcatgcctataatcccagcactttgggaggctgaggcgggtggatcacttgaggtgaggagttcgagaccagcctgacaaacatggtgaaaccccgtctctactaaaaatacaaaaattagctgggcatggtggcacatgcctgtaatcccagctacttgggaggctgagcccagagactcgcttgaacctgggtgacagaggttgcagtgagccgagatggcactactgcgctccagcctgggcaacagaatgagactatgagactcggtctttaaaaaaaaaaaaaaaaaaaaaaagaggttctggaattagagatgatggttccatttgtgaatacactaaaacccactaaatcatgcactttaaaagggtaaaatttaagttatgtgaattatatatttcaatttcttagaagaaaagatgacgatgaccaacatcccactaccaggacagcactcgatgaccctcacaggcaccacaatctaacaggtgagaatggtctcactgcaggcttaatttgtattttgttcattatgaatgacagtgagctaataaggcatttttttttcttgaatggtgtgtttggggtttcccctttattcaactagtctgtagatttttttcttattcatttttctttggcctgagtttaaggctaggtaatggtattcattcatccaataactgtatcttgagggcttagggttgcctcgccctgttctaggcagtggaatatggtcataaacatgacccacagagtcctgggcctcatgaagcataaatggtcaaggggagacacaaatactaaacagggaaacacacaccagccggcaacaagtgctgtggaaaaaactagagcaggtggggagagccaggagtggatgggggctctgttggtgataatatgggccagctggagaaggctcctcagatgaggtgacttctcacccacatgaagcaatccacgtagggaagaactgaccccagaggaaacagacactccaggcaacagaggaaagcataaaaagcaattgtaagggagagagacctggtcacctgtgtccatctgaggagcaggacgccatggctgagaatcaaccagactctaagaacagtagccaagacctgtagccatctcctcactgccccacacccacaccactgccagctcccacctgctgctgtgctacccacttcccacgtctgaccatctgtatgtccatcctccctggtaagccctcatccaagtggccatccactctccaatgcagggttgcagggcccccactccaccccagctaaccatgctcttctgagtcacggtcctgggggaagggggttctgttggcctcagcttctgaaagcacttccgtggctccaagaaggaagacagtgctggtgatttggccagcaaggcccagcctcaccctctctccccattgctgttggctggctctgctcccccaggcacacagcggtgcagggtcctgcccaggccagctgacatcactgccaagatgggactgaaatgtcagtgtctgcacacagctcgggccagcaaggcatcctggaccctggctggccctggggcttcctgttccccttgcctgccaagcagggccaactctgtgtccctcagaaggagccagctgggaaggcctgtggtcaggaggaggtgggccccagagtgtcccccaatcctcagagtccaaaacagaggatgttcctgcccccaccaccggcccccacgccaggaagctgctgcagccaccagggtctgatgctgcctaatcagggaaggtgctcctgcagggactttcacgtgtgtttaaaagcaagatttaaaagcaagattattcagtgctctccctcggggaaagtcccctggggagagggcacagtgctcacagcagggtccagcggccagggcaagcacaccacctctgtgtctcccaccgagggagctggcaaaagcccttcacctttctgaacttcagtttccacttctagaaaatgtggtgaatgccatgcacctgaaggaccggtgcagctccctgcgaggcaccttctctggcactgtgtacccttggccaatgcgcagtctcggagctatggaggagcgctgcctgggagccagctgcccggacactggtttcactacagctggggagaggagggccacctggaatgggggaatggggagagcacctgtcatggacacacctgagcagctatgacggtttccctgtcgggggacgcagagaccacctcccaggtccatatgccatcaccagccataggacacagtcgtcccagctgacccaggacagtgccaattccgcctgttgcttgacataagtcactctcagaaagtgccccaccccacccaagacgactgctagaaacagattcctgggctccgcccccaggccgagtgaatcagagtctgggggtgtggctctgaggttggaatcttctgccagctcagtgggagaccccagcacacagccagacttgagaagccccaagtgtggggtgtgccgaaggggaaggggggggtcaggcaccctagagggttccttccatgctccattccacagaggctccttgcttacatctgcccctcacctagccccaaggtcaggtcaaatgtcaaaagcacatgaggggcattgtggctccgctgttttcccacctgtcacctggtcaatggcggcttcccagctggaaggggcagagagggctggaggcttgggagtggtggtcctggggaacaaggctcaatggacccaggcactgacccgcaaccctgctgaagccagagacacctgggtggaggtggagacgtgcaggcaggagctgcccagggccaggcagaggctccagcagcgagcctcacagctgaagggaatgtgtgaggaggggcctgggccttgctctagggagcacctctgaggctgcagggcgtggaaggaagtgcctattccctgatggaggccgggaaggtgccagaaacccagaaatccaacaggaagggctgcaggaagaggcctgctctgctggctgggccctgatggcactcttctgcaacccaacctctgagactcagttttccttcctgccgcagtcccagcatgcagcactgatcagccagcggcagccgcctggggccctcatgaaaagcaccctgtgggttcggcaccaggtccctaatatccccccaatatgaggactgtgtgcttcccatctgcaccccgctgctgcctgaagcgtcttgtggggcccctcaccgtgctaggatttgcacctcagctggagtcccctaggaggcacaaaggctggagcaggaacagtgtggcttccagaacacactcacgcatgcccaggaaagaaaaagccacacagattgatttactgcttctgctttgccactgagcacaaggtgtcagtgtgcatgatggacgccagccgctgtgaaaattgagatgtcagcccagagcccacagcccacaccacctcacctccagacgcagtcaggggtggcacagtcctgttaattgcgagccctgagcagactgcgaaacgtgcttgttgagcgctacctggggagctcaccctgtccagacggttgggaatccacactctctggctcacgggacacctctgcttctgcctccctgtgcacagccacccctccaggactgtgagggggaccaggccttcgtctggcccagcactggtgtggaccagacccctgaccctcacaagtaccagttctctccttgctgttgtcaggttcggaagggacaggtgaaggtgctgtgccacagggagtctccccaacaagacggacccctggtgatgcaggagcaggcagacagggaggccctgctggatggtagcggcaccctgaggacacacagggtggtgtcgagctcccacctggccctggccatgaggagtgttgtcagagggtgaggacgcagagggcacctgtcgccattgatgctgggatgaccaaggacagtgcctggggcaggcccccagaagcagagggggcttgggggaatagagggctgacccaggcactcctgtgtgtgcacggtactgccacccacccacatgggtgtgcatacacaggcacactccacatcgtggacacatctttagtttcaagggtgtcagcaggtgggacacagagcagtgcaccccagaaggagcagacagaccagcacacccacctctccacagccaggactaggtgggcaggggaaccaggccaggagtcaagggcctggccaggcacttggagttggaaggcagggaggaaggggtgggctacggggctgcgggacaggccggggctcggcatccagcagctctttctagtaggcaggcctgcctgggaaggaagggcagggcattaatgggtagtcagtgactctgtcttccaaacccaactgcctggccaggcccttgacttctgcttagccatggactcccaggaagggaggggacgtgactgtgaggcagacacagtgcactttcttttctgaaggtctgatttcccctcacatgtcctaagctcaggggctttttagcacagacagaggacccggtttcagggctcggctgccaaactcacctgactcccactggcaatagagcccctccacagaggcttgcaggctccctctgctgcacacccagtgactggctcgcggcgggaggcagcacccgagagaggaccctgtgcctcctgctcaccctcgacacagacccactgggactaaccgctcccctgcaccctggcactcatcgtccgcaccccactggaacccacaatctgctgccaacaaccccagctctcctcacagagcaccgcaccccacgccttcaggaccagcgagttcaaaggagcccatcgtgggcaaacccccatggtctcctctgtccatgccccagacaaaggggctgtgcacacccagcccagggagggcccacaggcgggggtgcccccacacacttccacgcccaccgtagcaaggccacctgcaggaggggcctggccaggtccagccttcctgacacccaccccacaccccccaccacctcatcctgatgtgttcagcgggtgccacaacctccaaactaccccgtgtgtggatttgaggtccttgtagctccccagactgtaaactcccaaatccccggggagggctgccttgctcacctcatgtgagggattaggctctcaagagtgggtatggcccccaaatatgcccacagcctgatctccagaacctgggaatgttcccgtattcggcaaaagggactctgtaggtgtaattaggcagaggctcttaaggctgctgggagattctcctgggtgggcccattgtattcacaagtccttaaagttgaagaatctttccccgctgcagtcagagaaagtgtgaggacaagacagggtcagggagatggtggcgtcaggggacccaacacctgtggctggctcggagctgtagggagcctcacacaaggcccagagggggctctaggggccctcaggggccaacatcccacaggggacggggacctcaaggaatgagattctaccaacagacacctgcgtgaccacgattctgcctggagcctccgaagaggcaggccggccagcgccttgacctcagcccctaagacccgacccagcctctgacctactggccgagataagaagcatgtggtgcggaagcagctccatctgtgggacttttttgcagcagcaataagaggcaggggcagcccaccctgctttgagcaccagccggctggccacaggcacagaccacaggggcaggacccctctagggctcacccggcagtgcccctaagctgggcctggggcaggcctgcctccccatggggtctggcaccatcctccccaccctcaggcccacagagggcagacggagactcacatgccaggcccagtgctcggtggatggcctcccaccagggctgtgctctgtgaccccagctgtgcaaggaagtgggctgcaggaaaatatcccctgcaggaaaccctggagccaggacacttcagggagggcgggagacaaacagagggggccttcagggtcctcttgggaactgcaatgtgccagtggcaccaggacagctgtggggccatggagggctgcaaggggccatgtaggtagacccccccagtgctggcggcctccacttgttgcccccttagatctgtgtggtggggcactggccctcctgctgagggcacgggtttcctaacaggcacctatccttcaagctccttgggcctggcccagaccttccagccctgtgggctgtgctcttcctgctggtcctgcctgccctctccacctcgggcctcacggctgcaccgctaacccccgcccccggacctggtctactgttgcagggcccggaactgacaccttcacactcaggtcacagcgcagtgacacccggcctctgggcctcagctgctggcagaaggctgggtgggggctaggtgggggctgggagtccataaggctgtgctccctgagcaagtctctgtggtcacaggcaaggatggaaaccgctgctgtagctcagaggtaaaacgggtctctgtgggatgagctccaagcaggggtccaagcaggggctcctcctagggtccccagaataatccctgactaaagggagggaacaaaggagacagtccctttatggcacacaagcaatgacaccagtgactccattgggtctgacattgggacctccttgtgtagctggtagccccagggcccactggaggcccctctatccccgcactcctgacacactcggctgggaacactggggactttcctcctgggcagaggctccccattcccaggcatctggagaggaaaccgggaagtgtggggtttccagcacctccgggaagccccagccaccacctggtctctgcctggcagagtccagccccaccagcccagcccctccagccggtgtcgggcttggctgcagtgggaatgcccagcaggaaggacagcaggatccaggaaatctcccaaagtcactatgctgcacggccccacccaggccccagcgccctccaggcccctcacaccacctaggccaagccgcccagccctgcccgcctaggctgcccactcagcatcgctccttcctgccccacccactgccatctgggcctggacggctccaggatatcctggacagtggggcaggctgaggtgagagagctgaccactgtcctgacccagccccagggctgcaccctcatccaaaggctggggacagctgcccccacctcctcttaggctgcaagctctgggggcaggcacactcctcactccttgtctcacagccctgcccagagcctgcacctggagcaggacaggaacatcacagctctgccatgtaccctctgcagccaccactctgaggaggtgaggagtgtcactggcatttcatagcagcacagactgaggccagaaaccggaagtgtctgtccaaggacacaggacactggtcagggccagagttaaaaccaaaacccagactcccatgtcaggggaaccctggagccagggctgggggtgctggggtgggagtaggcacaagtgttggctcaggaccaccaggtggtgggtgtgtggccattcctgggcacctgtcacccttggcttctctgggctggctcctggcgctgtctgcccactggcaccccactcccccagaggagcaccagtctagagtgggggtgcagtgtggtctgggcttctccgatgccctccttcctcccctggttgccaacaatgctaaagctgcacgcctgtgatcagggaggccctctcagcttgactgctctctcctgccccctagagctaccatagtgtttagacagaggccatccccagcctagggggagcactgtgcaggaggaggcccccaggggacccagagtgaactgactttagggagcccatgctaatgactgtcctggccacactgtgccccacaagccacaggtggagtgaggatgctgagggggcctggagccaggacaaggcaagccaggcgggggcaggtgcggcaggtgctgctggagtcccccaacccctacccagaacacacagcagcctgcatccaggcagccagtgcggagcttggttcttgatccggctgtgactggctgtgtcctccctggaccatgtgctcagagatgggacaagggctgagcggcttgtcacaggcagaaagaagaacaggaacaggaacctcagggaaagaaagggctggttgggggtggagggggtggtgaatcaatagccaagggaggtgggtgaagaaagtgaggtgcagcaggtcaaatacgcagaccagagtggcctctccaggatccctgcccacattgtaatgcatgggctacctctctcggcttccagggcactgcacactcagtgcgactctggacctcagccgcttcccccacacagtctcccgtccctggttctctccacgttggggctgaggatgtgtctggtgtggaccagcgcacaccacagccacagagcagtgcccccactcgcgccatctgcacacagacacagatgagccgtgaaggtggcatgaaaccccgggcctctgttccccgactttcttgccattccctggttgccggcaggagtccatcttggggcccagctgtttcctctacaaccggaaacccccttcctcccttcatggttttgcccaaacctggccttcccagggtggctgccttcatcgctccctcctggcacctctccctccttccagaatcattaggctcatttctgtctatttttaggttgtgtctgcactcccagagtctgggccatgcctggcgtgcatggcctgcagtgggtgaggttgtgatccgacatctctccccaggtcaactttccactctccaatggttctgcctgagtccatctctcaggtgggggtgagggtgagcagcaccttgcagaatccctcacatggctccagaggtcacagcaagagggaggagccatgaggcctgggttcacaccctggactggccacttctcgttatcagcaccagcaggactcttgacccctccaagcctcgctgacacactggtgatgatttgcatgcccaccctgggcccacttgtgtctagacacccctcaccaggtgggcagctcatcagccacatggggccttgcccagcgagtcccacccatgcagtgtttggtggggaaggaggagcacaggtcccgcccaggaggcaggattctgggactgggcctgcctctgccgcctgggggcctctcctccacacctcagtcccatctggcctgcaggcaggttccagcaagctacattctccttcctaggagggtggggatgttctcagaccccgtagtgccctgcgcttcccccgggcctccccagggggtagtgactgcacacagcgatgggcaacaacagggtccagggtcccgtcagcggtgccctccccattctaaagcaggcctgggactcacattctccagagccagccctggccctgcattatgctgcactgaccattttcacatgtgctgtataatgtctggttgaggccaggggttctcccctgggctcccacagggctgcatggctgtccccactagccagggaaaggtgtgtcccctaggactgacagacactcctcccaccatccaggcagccagtgctctggccgaggcagacagctgcagcctggagaggacagacagggcgaggcaggggaaggcagctgcctgggccaggacatgagggcctccagtgttacatttacaggaggctcagaaaacaactaggctgggcaggtttccagtgggcatctggggtgaactccttccccattcaggatctcaggcgaaagctgcctctatactaggtggctcacagcttcggggaggggtaccctcatggaggtctgcctgctggagcccccagaaccctgcgccagtcaactcttcattgaaagatagggaggcgcagtttcgtttaactcaattttgcagcctccatcatctgagtgggtgggtatggagtgtctcatcttgaggtgagggattctgtgagcgggaggaccccatggctggcctggcctctcaggaggctgaggtgagggggctgtggaaggtgaagtcgcccctcctaatatggcagcaggagggtgaagtctagcctcggtcaccacttcccctgccccatgccacctgccctcctctttcatggccaacccagtgccccacctacctcagggccatctgccactctgcgcttgacaccagaggacaagtgcatttccttggggcaaagctgcaggccacagcaggcggctggccccttgggacgaggagagcagctcagttttggtgggccgaggggcaccaccagcagggagcctcagagagcctagcaggcttgggtgagctactgagctgcaggcttgctggatggatgccccacaggccagcccctaggagcaggactgcctctgtctcctctttgtgccacccacacccaccatccacccactcagcacagcctcttcatgcctggtgggctctcagggcagctcatgtgctgccacctgggctggccctcctggcaagctggaagagctcactgggcacatgggcctcctgaccaccaggcccgggaaggacagctgggggccagagtggagagaaggctgcagcaggggctgatgtgcaggccccagactccccggccagtgctccccaccctgcactgccttcactggcctggggctggccctggtctctggttcccccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcagggccaagtggctccccagacccagaccccacggagaagctagggtccgcccccctctcaggaccccagcaggcagactcccgtgcccataggaggcctggccactgtcccgccccctcccacctttcccactgcgggagccaaggaaggcacctgggtgtggacttctcctgtacaactgggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgggcatctccgagccagcactgactgctcagcctgtgcgcacccaccaggcttggtgggtgcctggtgaccgcagctgtgggtctcccctccaggccccacccatgtgggagcgccctccccctcggccccgccccctctgggaagtggttctggctgccgtggcctttccatgaagaacagctgggacccctggccatacttgccagcacagtttactatcagccctctccaccaccaccactccccgcagggcagttgatctggcccaggtacctgcaggtcacctcacagcaggtctaactcactccagcttggtcaaggtaagcccagctcccagaaacacctaggccagaggaggaaggggcacggggcatagaaggccctgtccccgtagcggggctgagcaggaagggccctgcctgcaatggacagtgtgggcaggacttgggctctcccaggtgccaccaatgctcacctggcctggcctcgccagtgggggactccactcctcatccagccacccactgctaacagcaataataaaatgaataattgatgcagccccctgcctgctctgagtaattaactcatgaaagcatcagggcacccccagaactcccaacctcatccaagccccatcctcccagctggtccactcaccctgcctccagcccacccttcctcccccagctctgagggcagaggcttgggtcctagcaactggggccaaccctcctctcctcagccagcaaagccggggctgcccagctctcacccagagcctggctcggggctgcacattaccttcatccagaccacagccctgggagaagcagggctcacagggcatgctcagagcaccggccagaaaaagctgggcacagaactagcctacagagaagtccaggcaggagaaatctggaccttggagtctgcgtctgtacagggacaaagtgcagatcctcatcctgggaagtacctggtgctgtggctgggcatgtctccccaggccccaaggaggaggcctgccccagtgccccagctgtggctggggtccaggacacacccggatgcactcaaggctgcctgacattcacatttggcgggtctgggtaccagagacctggagagccccatgggcagagagagtgggggagggtccaccagatttgggcagccttggtgggggtggggaaacaagccctgctgataaaccatcagaacgcgccccctctcctctcccagctcccgccagcctcctccacggaagctactctttgttaacagcgttgccatggcaaccagatccagggagaactctctcttcaaggtagagtctgagggtgacacttggagaaacagaagtggtggtgacaacaaacagggtgctggcctcccagccccaccccccaggattccttcctggtccaggaccccagacaccagccccccagactgtcccagagctctcaggtctgcttccctctcctctcctctccctggcgtgggtgcagcaacgtggcccaggccaggcacctctgccacaccatgcacggtggctcaggcacttccatgcacctcccacggatgttcgctgaatctgccagcatagccactgtctcgtggctgggctccaacaggcctggtgcagactagaccccaggggatcatagacaagtacacccaaggcggctgctgcagagcagccccgggccccctgcacagcaggaaagttcaggaaggcacccaaggaaggctgggagcctcctggcaggagggagacccagcagaagccatgccctgagtaggggaacagactgctgggtaaggaggccactgcaaatgtcctggccaggggatggtggcccggcccacagaggtggcagtgagcagggagaggcagaaggggcagaagagaggtctagagtggggtgtgctagactggctgacaactccaggcaaagggaagctggcagagggggtgagggagagccagctgcctacctgctcagatggggaacctggggcaggcaaggttcaggggcgtgatgatgtgcatcgtcacccgggaggcgtccagcaggctcacacactgacagaacccagaggacaggtgggggctgatgagagctggaaccggatcagcacggaggagggaacagatgctgtggctgggtagagggtttgagcccaggtcttgaggaacagggactttgagtgtcccaggatgggaggaggagaaccaggggccggccaagcccaggaaatgggtgtctgggaacaaggcagtggacatccacggcctctcaagaagacatccctggactgaaggaggtgtgtgcagattggcgtgggtgggagtgagtgggaagtgaggattcagagtgagcagagaacatgtcttcaaagtcagcccgcacaggcgaccagggtgcggacggctgagcaagtttcgttgtttttaaaaaaggaaaagcacctgtcaaccggacagccacatctttgcatcccacgtatgaagtgcccaccctgggctgttctgtctagagtcccagcccaggcctctcttcttcaagctggtgctggcctctgctccctgaattcacaaagaaccccacagccagctcacaagagacaagcaggtctcggagcccctgctggctgccctgggcagcacaggccggcagctcagcccctaccccagcccgggcagtgcccagggcagggcgggcaaccacaggtggggagaagcttcccagaacaggatcactgggtgtcgtcctgagttgtgcccaaaggcacccatgtgcttcctgggaggtgctgcagcagagccgggacaaccggactactctccctgcctggcttccctctccatggtccaccgggcaggggtggccacagcagcagtcacacccccaccccgtccatcacagcacaggccccgcttgagtcctcacacctgtccactcctggccggtcacccctcacagccctctgtcatggtgcctggagcagcctctaccagcctgtcccaggtggtgagccctgaggccagagcccctctcccactctgagcaggccaggaccccgaggggctttcgggcttcccttcacacagtgcccgccaagccactgctggccataccagctgaccttcccaaaccctgctcccgggctgctagctggggaattcctggtgtcccagcgcgcagggacattctgcatgggttcctggcagctcgccactctgggccggcccagagcccactctcacatacccacagccccaggctctgtgcccaaaaagtggcgacagggatacacccaaaaagtgggcagtgagccctctctggacccccgcaggtcaggctgacagccataggggagggcctctgacacccccagcaatccaccagtgggtatcagaggccctcctctatggctgtcagcccaccagtgccacttcagtcccctccctccgcacatcacacccttgctaggtaaacactcatcctccccagcagggagtgggcaggggagggcagaggagccgggaggcaggctggagtgggtgggagttacaggaggcagattggaagctccaacagaaaagcagccagagtgccggacccaagcagatggcctcaggagaaaaagggggaaggggagggagggtccgtcaaggggcagcagggaggggtgggggagaatgccttgagtctcctccccatctgctatctgctatgcccctggcacctacccccagcagcccagcgcccctcccctggggtgggccatgcagagaagagcatccctccaccagcccctctcctgaggacagtgggggggccaaaccccctgcccccatccctgccttggcacagcaccttcacttgacctatttgacaaatagggcttctgtgaaacccacggttctattgccaaaaaccaaaggccaaccaaagctgtcccatcctgcccctggcatcattctacaggtggggaccggcgtgctcaggggctcctggccacactgtgtcccagtgcccactcgctctcctccctggctggcccctcccaccgctgggggccactgtgtgcgtggctctccccaccgcagccactgtccagcacaaatgccatttctccctcctcctcctcctcccctgcctgcagttgctaagttacaccaaaaaacccctctgctctgtgtgaactgttccatttccacgatttgccaggtggaagggagccatccggctggcagctcgaagatgcctcccagagaaaaacaaactcactggctggccttcaggccaaggcacacctgggatacctgcttggttcacaaacccaggggcatgtgcaggaggacacagcttctctacttcactagagagcctgggggatccacacagctcatgcccttctcaggagcagggagtgtgggcctgctgcacccgcctcgctgggtcactaccacccacagccctaaggacacacactggctggaggggcagagaacccacccacgtgtccctggccatccagccaaggtcctccatgtccccctgctccggatctccccttcctgggctggggtcctgaggttccaaagcaaagtgtcactggacatcagggtggaaatgtcctcagaggtcatcaaaaccgtgtcagtctacagatggggaaactgagtctcagaagcctgcagcctgcccgtggttcacgaatcaagacctgtagcctttcggctggaggccccctagagccgcttagagtccagggcaccgaggtggacaggctgggctggcaagactgcatccggagggggcgggagaaccctggggggacagagggaaccaaggcctctgggaggctcccctgcacccagcctgactcctgtgtttcaggatcctgcggccgacggccatcggggcccttcctgcgcaggacagtgggagaagagtggcagtggtggggagggtgaaccagggagaagctcactgctctgagcagggagggagggagccccggccaccaccaggtctctgcccccaggtggctcccaagaggcaggcagcggcctctctgtaaatatccaccaggtccagcacccagaggcagccagaaatgcagggcacaggaacctgccagcgcgtccctccacacacagcaggggactcccgcccccacctctcactcaccgaccctcggaccagaaccagctgcacctgccccgttcctggggccggcaaggcctggggcaaagagagcgtggtccttcaaatgacccttgcccagcagggagagggagacacctggcatggccctggacctctcccccaaatgcagagctcaagccccaattcctcgccaaacagcaagggcgtgagataccacggcggggcccagaatgcagaagagcaaatggaaacttccaactgcgcagccctgagctcctccgattccccagcccccacccccacgccaggccccgggcagcgaacctgcccgcagtgcccacgcccgcccgccgcgtgcgctcctgccacgcccggcccggcccggcccggcccgccaggtgccctgaaggggcggagggtgcagggggtcctggcgccgtccagcccggggcggagttctcagcaactccgcgcgccgggatcccggccgccctccccgcgcgcgtcccccgccccgcgcccggagcccgcgccccggccccacgacggccgcgccgggagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcggatcacgaggtcaggagatcgagaccatcccggctaacacggtgaaaccccatctctactaaaaatacaaaaaaaaaaattagccgggcgtggtggcgggcgcctgtagtcccagctactcgggaggctgagggaggagaatggtgtaaactcgggaggtggagcttgcagtgagccgagatcgcgccactgcactccagcctgggtaacagagtgagactccgtctcaaaaaaaaaaaaaaaaaaaaaaaaaaaaggatcaggcagcagacaagctaggaggcgatgcggccaccgcatttaaaaggccctctggggactcccgcagagctggcaaaatttttgtcagtggaatcagacggtgaaagcccttctgtgggcaagtcctggccccttgggtcactccccttaaccatcttaatcgccctgtaaggtcggtggtggatttgttcccattggacaggttagtaaactgatgcacagggagtgcggttaccctgcagggtctcagagcctataagtggcagagcaaggctccaaagccaccttgaaagatttcagaaccactaaagcaggacacaggtcttctggcgtccactggaacttcctgtcgctctgaagggtcaccttctcttgaacggacaccctgtggcctgaccccagggtggcccagagtgactcttgcaggcagtcagacgagggccagtgagaaacaggtctggggcgacgatgtccccaggtggaggggtctgtgtgaaaaaatggggaggagccccacagcaccccttgaagaggctgaggaccttgcttactcacttagtccttgtgtcttgaacacctgtatgccaggtgtaagatggggcactgggattcggctgtgaatgtctctgtctggttggagtttgcattcttgtgggaagtaggcagtgaataaaaatacacataaatagttcatgtgtcagatgctgcagatcccacagagaggcccagcagggagagggagccagcgaagggagggggaggggagcttgtagggtgggggattcttttttattttttaaggggaggtgtcactgtgtggcccaggctggagtgcagtggctattcacaggtgcaatcactatgctctacagcctggaacttcctgactctagtgagcctcctgcctcagcctcctgagtagctagaactgtagtttctcaccaccacccttccctgctgggttggggattttattttgggtgatcagggaaatcttggctgaaaggatcatatctgagctaagacctaactgaggcaagctatgctgaatccgaggaatgaacattttcagcaaagagaacagtacatgcaaaggccctgaggtggaggatgccttagaaggaggccaagtggagatgagtgagtgtggtagagaggagcctgcaggagctgccaggtggaccatatcgcgaagagcctggccagccatcagccctctgtggctttgactcagagggaggtggagggttttgcacaaagtaatatgatcttactattttttacaaacaatattttattatgtaagattttaaacgcttataatagtaacggctaaaaaggtatatacaataaactcaatggcccaacttcaacaattatcaatacatggccaattctgtttcatctgtatgcccacctaccactccccatattatttatttgtttactcattttaagtaaacttttatagcttttttttttttttgagacagggtctcattctgtcccccaggctagagtgcagtggcacaatcatagctcattgtagcctcgaactcctgggctcaagcaatcctcccgcctcagcctcccaaggataattttttgtaagtataacatgcatagacaaaaatcataaagttgtgctccatgaattttcaataagaatacacccattcagtgagaatattaatagctctctgcacctggattttcactgtagaaaggtttttaatgacaggttcattttctttaatatataggaccatgtagattatttgcttcttcctatgtaacttttgcaaattgtgttttttatggattttgcccattttctctaaattttcagattttctgacatcctcatattgttgtttataacatcttttatattatcccgcagatgtttgtagaatctgtagctatgtcccacttggattctgatattggggacctctgtgtttttcactctctttttttgatcagtcttgttagggttttgtcagttttataattttttttaaagaaacaacttttgactttgttcagctttctctgttgtactttctatttcatgaatctctgctcttagtttcattgtgtttgtagctctcctttgggggagtattaactgtctttctctcattccttccttcttcctttttagtttctgaagttggagggtaggttcattggttttcagctttcgttcctactctatggacttaaagctatatatctgcttgttaagcactgctttactctctctctcacaattggtgtttttttctcactatcattttgctcaagagacttttaaatttccattttgacttctcttttggcccatgacttatttggaaggacattgcttagttccaaatattaggggattttctagctaccctcctgctgctgagttccaatttaatcacacatcaggcagagattttctgaaatctgttgatacattctttatggcccaaaatatgttctgttttgataaatgccccatatgcccttgaaaaagagtgaatattctgtatatttcagttaagtcaggttggttaatcaaagccaaatcttctatattgttaattaattggatctcatattctatcagttcctgagagaggtgtctgaaaatctccagtatggtcccaaactggaaacaacccaaaagtggctgactggataaactaactgtgtgtggtgtatccatacaatggacaactactcagcagtaaaaaggagcaagccattattcaatacaacaacttgaataactctcagatgcgttaagtgaaataagtcagacttcaaatgatccattggactttttttttttttttttttgagacagagtcttgcactgtctcccaggctggaggacagtggtgcaatcttagctcactgcaacctccacctcccgggtttaagtgattctcctgcctcagcctcccgagtagctgggattgcaggctcctgccacgacacctggctaattttttgtatatctagtagagatggggtttcactatcttgaccaggctggtcttgaactcctgacctcgtgattcacctgcctcagcctcccaaagtgctgggattacaggcatgagccacgacccccagcccactgaacttttatatgacattctagaaaggcaaaactgtggagatagagaacagctcagtggctgcgaggaacaagtagtaggggaaagtgttggctagagccttgggaaatgtttaggcaccatgaagagtgtccctgtatcttgatttgtagtggcagtcacatgactatgcatttgtcaagacttaaagtagctgcacagcaacaagagtgaattttactgtatgtaaattgaaaactaattttttttttgagatggagtctcgctctattgcccaggctggggtgcagtggtgcaatctcggctcactgcaacctccgcctcctgggttcaagtgattctcatgcctcaacctccctagcagctgggattacaggtgcgagccaccacacccagctaattttttgtatttttagtagagatggggtttcaccatgttgcccaggctggtctcaaactcctgacctcaagtgatccacccaccttggcctcccaaaatgctgggattacaggcgtgagccaccatgcccagccaaaaaataatttttaacctccaatataattagggggcttttgtgaatactttctcatcgcttttcattcaggtgttgcctatgagtttttggttttcaacctccttttaccacctctgtttttacctggcaggcactcttctgcaggatggtgttctggccaccagattcagggaaaggggggatgggaggcacatctccaaggatatctgcatagcaggacgcagcagtactttgagtgttgcttcctttggggctttgaggtagaggaacttctgctggctatggaagctaaaacctgtacatcaatgacacttcagacacccactgtttactgtgacacagatattgtcctgcccaaaatgtgctcccccttcaagatctctccaaggtagacccatcaccacatggcactggttggcagcatggatcattgactgtaccaggtcctctagatcgctgagcccccacagaccagctcttcccaggatttcagctttccccctcctgattccacatgccagttcattcagctttgtttccacagaatggattttcagttattccataccaataccctacatttccctgttccttttaccttcatgtctcccacctggcagaattcctgtgacagaggaatccaactctgccttctccaggtctcccattaggttttcagcactgtagagcagtggtccccaactttttggcaccaaggaccagtttcatggaaggcaatttttccagacagggcagtgtgtggcaggggagttggtttggggggtggtttcaggatgaaatctttccaactcagatcatcaggcatgagattctcataagaagcacacaaccttgatcactcacatgtgaaactcacaatagggcttacactcctatgagaatctaatgtccccactgatctgccagggggcagagctcaggcgggaatgctcccttgcctgcccgctcacctcccactgtgcgaccccattcctaagagaccacagaccagtgccagtctgtggccttggggtggggggactcctgctgtagaggatatcatagggtcctgctattatgccaaattcacgataaattcttctgtggaacagagaactcaacactactctgtcatcctgctatgttcctgtctctctctttttttttttaattgtgaaatatgtcctacatactgaagaactgtgaaatgtagatgtgcagtctcaggagcaaacccatgactggggtgaagcagtggggcacaagccctccccaccacctcctcccagaggtaaccactatcccgatgtttatttccctaaccccttaaacttccacccctagataggtatgccgggttttgaacttttgggaatggtttcaaactctttctactgtcacttgtttgtgtcatcaatattatgtttgtgaaatccacccatgttgatgggtgtagctcttgttcatttatgccaactattgtttggtactcaatggaaatacagcacctccccctgcccctacatgcagggtttcactttccgtgttttagtcactggcagtcaactggagcctaaagataggtgagtataatacagttaagatattttgagagagggagaccacattcacgtaatttctattatggtatattgttataattgttctgtttattattggtgattgttgttaatctcttactatgtctcatttataaattaaaatttatcatagatgtatatgtataggaaaaaatagtatatataggctttggtactatttgcaatttcatgcatctgctgggggtcttggaggggacagctaaggagagactactgtattctgtagtatcccaccatcaaaaaagttgtatatgaggtaatgcatatgttaaccaccttgatttcaccatttcacaatgtatacatattttaatataacacattgtacactataaatacatacaacgcttatttgtccatttaaacaactaattaacttttaaaggcacactgtaatacatttatccaatctactgctaatagacatttggggcattgacatatttttgctattatgaacaaagctgttatgaatattcatccattcactgaacaaatgtttcttgagtacctactgtgaactggccactattttaggcatggggatacagcagtgatcaagacagacgaaaattccttcccacaggggtattctagaggtggctgactacaatgagcaggaaaaaacagggaaattgtgttttatgttagagggtggtaagcactcactgggaatgaaaaacagagaaggtgaaaagtaccagggtagaggctacacagccctgagttgatatgtaggtggagacttggggtgaggacagtgctgtgcagctgtccagtgatagctccagcagagggaggggcctgtgcaagggggcggtgggtgggtccacactgagaccagtggagaagggcctgggcaatgcagggcagcctgactccccaggccgaggccagacctcacaggttaagagtgccctcactgaaagacacaccacaaatttggaggccccaggccacctgcacttttgaccaactgggtacaaatttagcgggtccccctcaagtggaattcactggaacacgctcggaactcaggcagcgctctgctcatgacgacagcttcaccatagcagaaagggccgagtcaggaccagccacaagaagagtctcaaaaaaatgaagaagtcttgaaggacgaggtctgggagggtcccagatgcaaagcttccatggcctctcccagggagtcaaggacatcaccatcctgacacatccgtgggtaaaaacatgcaaaaggcattgccgatgagagaggttcacctcagcttgtgtgtctagagttgggtttctgcgtccagggcttcattgcacaggcatgactgagccaccagcaccacgtgctttgcgctgcagctcctcttcccagaagttgggatgatagcatgtggctccaaggcccaccctctaatcacggggttggtctttcaggcctgaccagccccactctgagccatcttggcataaattcagatgtggtctgaggtgcccaccaggaataacaaagacattcctgtcactggggaaattccaaggatttagaggctcccttccagaaaccaggacaaaagctgtcccaattcctcattccagagcagcctgtgtggctggagaagagtaagtgtggccaagaataaaaggaggcaagatcagagggttatgaggaatagacccagggagtactgggtacctgtctcctggtgcccaggtgcaagagttccccaaacgtaggctggaatttgcaactcctgggttgtacgcaatacacatgttcaactcttgggaaatgtcccattgttttctatagaataacgaccccccaaatgtctgtgtctgaatccctggaatctatgagtatgtttctttacatgatagcagggacattatagatgtgattagtggaggatcttgagattattcagatgggtcatctcatctcaagggtccttacgagagggatacaaaggggtttgagtcatggaaggagacgtgatgacagaagcagaggccagaaagagtgagactgggcacagtggctcacacctgtaatcccagcactttgggaggccaaggtgggcatatcgcttgtggaagttcaagaccagcctgggcaacatagtgagaccctgtctctacaaaaaaatacaaaacttagctgggcttggtggtgtgcccctgtggtcccagctactccagaggctgaggtgggaggatcactagagctggggaggttgaggctttagtgagccatgattgcatcactgtactccagcctgggtgacagagcaagaccctgtctcaaaaaataaaagaagaaagagagaaaaagtttgaagatgctccactgctggctttgaggatggaggaaaggactaaagccaaggaatgcctgcagcctgtggaaggtagaagagccacagagacagcttcccctccagcctccagaagcaaccagccctgctgacaccttggttttgtcccagtgagactgattttggacttctgacctctagaagcataagattgtgggtttttgttgtttaagccacaagatcgtggtaattcgttacagcggtaggaaactaatacacaatctttgcccacccctctaagtgatgacttccctactttggccagcctgttgattaaattgtgttgtctcattgtggatttcatttttactttcctgatgatgaatgatattaagcatctttgcagatatctattaatcgtttgggtttacgctttagcaaagtgcctgctcaagatttttgctcaggttttttcccccatggtttttagcatgtatacagaattgtgtagccatcacaacagtcaattttagaacaattctatcaccccaagaggaaaccccaaaccatctagctgcttttcccacccttccaccccctcccagtcctttgcaaccattgatctactttgtctttatagatttgcctattctagacagctcatgtaaataagaaccatataacatgtggccttttgtgtctggcttctttcatcttgtataatgatgattttcactgtttttaaactgacaaatttaagttgtatacatgtattgtgtacaacatattgttttgcagtatatgtgtattgtggaatggctaaatgaaactaattgacaggcactacctcacatacatgtcatttttgtgtaatgagaacacttaaaatctactgtcttagcaattttcttttttgtttgtttaatatttattttttatttttatttttatttttttttgagatggagtcttgctctgttaccccggctgaagtgcagtggcacgatctcggctcactgcaaactcggcctcccgggttcacgccattctcctgcctcagcctcccgagtagctgggattacaggcacccaccaccaagcctggctaatttttttttatttttagtagagacggggcttcactgtcttagccaggatggtctcaatctcctgaccttgtgatccgcccgccttggcctcccaaagtgctgggattacaggcatgagccactgcgcctggcctatttatttatttttacagacaccttcttattatgttgcccaaggctggtctctaatgactgagttcaagtgatcctcctccctcagcctccccagtagtctcttagcaactttcaagaatcaatacatggttatcaactatagtcatcatgttatacaatagatctcctgaacttattcctcctgtcgaactgaaattttgcatcctttgaccaacatctccccagccccacccacccccagaccctggcgaccactgttctactccctgctcctatgagatcaacctttttagattccacatatgagtgagatcatgcagcttcatccgcctgtcactggcttagtttacttactataagtcttccactttcatccatattgtccaaatgaaggatttccttcttttctaaggctgaatagtattctgttgtgtataggtgccacattttctttatcaattcatctgttgatggacacttagtttgcttccacatcttggctctgtaaatagtgctgaaaataacatgggtgcagacacctcctcagcacactgatttcattccctttggatatatacaaggtagtgggattgctggatctttgctcagttttctattgtttattcttctcattgatttgaaagatttctatatattctaggtgctagtacaatgagagttaaatgtgttaaaaatatcttctccccctttgtagcttatgttttactctctttgtgctgtctttcgatgcaagaatgtcttaacttgtgtaataaagtcccccgtgcgactctcttcctttatggcatgagcttgtcagcctcctcttctctaaattctcaaaacattcccaacaatttcaaatcctccagccttctcccagccttctctctattcccctgcctgtcaaagaatgactctccctcttttacatcctagggaaatttgaaaccactgttaggaaccgtctcaactcttacccccaagtttatacacttacctgcatacctcccttcttccttcccatcataaagttgcacatggtctctttttttctctataggtcaccctctctccctctgccctgggtaccatccccaccaccccatcctctttaatattgtgccattaaatatatctttctaggagagggaaaactatttttcctctacccttttaggttctcagctggggcccctattacaaaaggcagattgacaagagaaaaacagacagaggccgattaacatgtacatctcatatatacattggagatatatatatacatatatgcattgtatagatatatacacttattgtgtgtttgtgtatatatatatacacacacacacacacacacacttatatacattggagaaactcagggatgagtaaactcacagaggtggctagaacttgggcttaaataccatcttcagctaaaacaaaggaagaagggtgtcagggaggctagttatagggatgtgaccagtaaaagcacagtagcaagcgtaaggtttggtatgcaaatttaattcagtgcctcctccattgataagagtctcttatgatttagagccatccttttcttactggtatagagagagacacccttacaaattgacactttttaaaaataaatgtcccttataaaggggtaattattttattatttatttatttattgagatatggtctggctctattgcccaggctggagttcagtggcatgatctcagttcactgcaacctctgcttcccctgttcaagtgattctcccatctcagcctccggagtagctcagattacaggagtaatccaccacacctggccaggattgtgacattttccataaaggccaatatatacatacagcaatttgactggttacagcttgctgcatgccaaggaagattgcttgaatattctgtgaggaggggtgatgatctgcaggggtctcatctctggcgcagcaaagcctttcctaatcacttacaagaagaagcagaagttgcagctgcaggctatgtgactcaggctgcatagccacattcctctcaaggctcagaataatttaaagttccaacagctttaagtttgaattattttacttcacacaccccaaaatatgcttctttggcatgaggatttctttgagctcattaccttgagaaacagcaagctcaagagaagctctaaaagcagaatataaagtacccctttagagccaggaatggtggctcatgcctgtaatcccaacactttggaggctgaggcaggtggatcacctgaggtcaggagttcgagaccagcctggccaacatggtgaaacccccatctctactaaaaatacaaaaattaaccagctgtggtgacatgtgactgtaatcccagctacttgggaggctgaggcacgagactcgcttgaacccaagaggcggaggctgcagtgagctgagatcataccactgcattccagcctgggtgacagagtgagaccctgtctcaaaaaaaaaaaaaaaaaaaaaaaaggaagaaagaaagaaaagaagagcatcagaaaatgaataaatgaaggtaaaataaaaactggaggtaaatgaaggtaaaataaaaagtgaaacgatgtgtgttattattttgtgtatgtgtttgtagcaacttcaattaccacttctgtttccatgcttgtgtttatccataaaataaaaggatgaaaaaatgttaaaaaaaaaaaaaaagtgaaacgaatgacagcaatgatacaagggatgggggaaaaattaggactattttattttattttattttatttattttgagatggagtctcgctctgtcgcccaggctggagtgcagtggcacgatctcggctcactgcaagctctgccacccgggttcacaccattctcctgcctcagcctcccgagtagctgggactacaggcgcccgccaccaagtcccactaattttttgtatttttagtagagacagggtttcaccgtgttagccaggatggtctcgatctcctgacctcgtgatctgcccacctcggcctcccaaagtgctgggattacaggcgtaagccaccgcgcccagccaggactattttatttttataaggtacttgaactccccatgaaatgatgtagcatttttgttttgttttgttttgttctgttttgtttgagatagggtctcactctgctgcccaggctggagggcagtggcacaatcatggctcacttcagccaccatgcccagctggctaattttttattttttgtagagatgagatctcactatgttgcccagactggtctcaaacttctgggctcaaaaatcctcctgccttggcctcccaaagtgctgggattacaggcatgagccactgcacctggctaatacagtattatttgaaagtggtcttggactagctgtaaatatttagtgcaaactctagggcaaccactaaaaaaatgtttaaaaaaagaagtataactgatatactaagtatacttatcagcataactgatatactaagaaaagagagaaaatacattgctcaattaaaaccacaaaaggcagaaaaagtgtagtaggcaaaagtaggaaaaaaggacaaggacaatgtatagaaaacagcagcaagtatggtagatattaatccaactatatcaatagttacttgaaatgtcaatggtctaaatactaactaaaagagactgtcggagtaaatcaaaaaacaatactcaactatatgttgtctataaaaaatttacttcaaatataaaaacacatatagattaaaagagatggagaaagacataccatgctggcactcatcaaaagaaagaaggagtcgctaaattaattaatttttttttttgagacagagtctcactctgttgccaggctggagtgcagtggcgtgatcttggctcactacaacctccgcctccctggttcaagcaattctcctgcatcagcctcccaagtagctgggactacaggcgcatgccaccacaccacgctaatttttgtatttttagtagagatggggtttcactatgttggccatgatggtcttgatctcttggcctcgtgatccacctgcctcagcctcccaaagtgctgggattacaggcgcaagccaccttgcccggccaaaatggaccaatttcttgaaagacgcaatttaacaaaaaccacacaagaagaaataaacaatctgaataggcctatatttactacagaaattgaatctgtaattaacgaccatccaaatcagaaagtaccaggtttagatgggtttcctggtgaattctaccaaacatttaagcaagaaattatatagtctctttcacaagatagaagcagaaggaacatttcctagctcattctatgaggccagagttaccctaataccaaaatcagacaaagacattacaaaaaaaagattcaactatttaagaaaatataatctatacatacccttagctgggttcatggaaactacaataagtgcaaaattctgaaagcaagaaacatgtgggggaccactgctctctctctgcagtggggtctcctgctctgatccagtgggtggcctttaccagaaaaaaacagaatccacctgacattggatcaaggcaggtgccggggtcagtctgcaaattagttattagtaaagctgaatttctgtattttaaataaatagatataaatggatcatcctgcttacccaacactggaaaccgctgctatatttgggaacaaatagtcaccaaataccagcccagtgctgagtttgtaacatgaattactttatttaattatcacaactatatgaagtggattctaagataccacccatttatgaatgaaactggtggctgggcgcggtgggtcatacctgtaatcccagcactttgggaggccgaggcgagcagatcactgaggtcaggagttcaagaccaacctggccaacgtggtgaaaccctctctctactaaaaatacaacacaggcatggtagcgggagcctgtaatcacagctactcgggaggctgaggcaagaaatcacttgaaccgaggaggtgcaggttgcagtgagcagagattacacaactgcactccagcctaggtaacagagcaagactccatctcaaaaatatatatatatatagatatatgcagatatagatatcatggcagccatagctggggcagcatccccgttctttgcttagtgcagtcactcttcttattggacataaatcaagtgcgaccttatgccccaccttctcagtgacccaaggctccagtcccttctcagagggagggtaaaatccagagatgccccagccgtcttgcctctagttcttggatcttcacaataagcgatggtcatggggctctgccagtagttgggtcaggatttctttctatttggtgttgtcccatccttttctggaagaatatcttgaatatccaagtttctgatttgtcaatgtcacacccctccaatttctggcatcgatgcacgctttttctatttctgtgttctgttcttggctatttcaatggaaatttggaaataacttagaggtgcatgcaaatgtagccattttatctggaagtctcttgcatcaagtacaaaagctaaatgttctttttgcctctagaatgtgatcatgggcaaattttctgaactgaggcattatttgtctcatctgggctaatggcttgtacctgaaactattgtctagagtgtatttctgtcaaattagtggaggcaggaggagctggaaggtagaggaaggcaggatcttcaaatgttcccaggatgcacttttcagttcaccccacccggacctattcaaaggctgctgtttacaaggctctttctagggttaaggttttcagtgtgagctctgtgagcccctgaggagtgggaagagactgagtatgagactccagcatcccccattttttccacttcacccaagcagcttcgtgagaagatctatgctaggaacatggtccaaatcctggttggacatttacagatgatgtaagcaggaccgagccaggggcaccattccagagtgggaagggagcaggggctcctgggtttcagtcctcgacctaagtcaggaattcctgagccaggagccaggaagtcctatcagacctggaaggaccctgtcacaagaggtggtggggagtcctgtcctctctgtacctgagggtaaggtacactttgcctccttaaggagatccaatgtctctcatttcacagaagaaatggggatgtttctattacatggaaagtgaaagacagcaacatcaaagcaacacttatttagggctatgggcaagactgatgtctctccaccctggagagcttccgcctctgaagtgcggaatgcgccccagcagcagctctgcaaggaacgagtccacatagggctctcagcacccgcttctgaggctgaggacagccaggcagtgtcagacatctgctgtcgttaaggctcaggatcctgcaactctgcagcctaatccagctttctgcgaaagttggaacctctctctgtctgagggtccttggctgccggccacaaagacgtgcgctgttggtcagcaccgaggacagcacttgggggcggtgctccggggaattcctgggtgacgaataccaggacagaaggaccttcttcccgacagcaggaaggatcaggctgagggtagtagtgtgcccgggtagtagtgtgcccaggtaccctgcaaatgtcataggcagctgacgagccccttctcgtcatcagccagggttaggattatctaactgcaccctaggggctaagaggccaaagacatgagtggaagccaagggagggttggggggccagatgacctccctggacagagagatgctatatgttccccagaatggcaagccctgcccaaccagcacagaccagctctgtggctctacctcccggcccaggacacaccttctctctctggcctgcctgctcacactcttgaccttggggtgctgtgctttccaagggcccttggtgtggaatggaaatgcctttactcatccacctttagtggagaaatcgtgagagcagcaggggccaatgcaagagagagaaggccccactgggatgaggctgcccagtcctgccgcaggtgccagcacggctgctgcactggggtagagctccattcaaagcgaagctctctgttcccagcgttatcgagtggtgggacactgttccctctttgcccctcgaagggctgccctctgctgaccacttcctgtcccccacccactaatcctttccctgcatcctctctgatcctcacagcaccctgtggggtgggtgctactgttgttcccattttgcaggcaggaaagacagagaggacaagcgacagtgagtggtggagctgggactctaacccagctctgtttgctgctagcatccttgtgttgtgctgcatggctccaagggttctgtggtaaggttcacaccacagctgagctccagggccttcctttctaggtagccagaggccatttagatttggagctgggcacagtggctcacgcctgtaatcccagcactttgggaggccgaggcgggtggatcacctgaggtcaggagtttgagaccagcctggccaatatggtgaaaccccgtctctacagaaaatacaaaaattagtcgggcatggtggtgcgcgactgtagtcccagctacttgggaggctgaggcaggacaatcacttgaacccaggaggtggaggttgcagtgagccaagatcacgccactgcactccagcctgggtgacagagtgagactccatctcaaaaacaaaacaaaacaaaacaaaaaatagatttggaggtcagacccaaatggccatgctcggtgctaggcttacaaggttcctgtgccctgaagctgagagtccctggaggaaggcccgtattaatgctcacatactcacacaaggccagcccctcctagcctccagtgtctcacctggtctgtgaagggcatgactgacagtcgtgcctctcccatagccctgtccagggtactgagcaaggatcccactgagaagtatctggtccaaggtacatacttcagaaacatgacctcctttctggctacatgttggagacccaggaactcagcctggttttttggacactgagtcaccagcaggtctccagccaggggctgtgaaggttgagcatgggggcctccctggccacatggggctggcatcccaaactaaaaggtgagggggtccaggggcacatgaaccagaggcagagagagatgggggtgctgtgagctaacttcagtcctagcactgccacttaactgtctgtgtgaactgggccaagtcccttgtgcacctcagaagcagtttccatgtcagtaacaggggagtaaactgagggcacctctttggataaaggaggagggaacaccagggaagtgcctggcaatggcaacagagcacacgaacacatgcacacacgtgcatgcacagcccccccccccaaaaaaaatactcttaattagcccagcagtgcgagccctcacagactgggttttgaatggtaaaaatagtggtctgagagtggtgagcccctggaggctaacggcattcctcaggaggtacagtctgtgtccctctcgtatggggcacattgagcctccttaagacagtgcggatggtgagtccctgaagaggaacatggggccctgtggaccctgccatctgcttccctcatctcctgggcccaaactggcactggtcaggagagtctgtggggactcccttctcatctcccctctttccctcctcctctctcttctagaaagaagacagagggaagaggatgcactgccttcctgctaatggagggggaggcttgggcactctcttctttctagaggttgatgcgtttgtcagaatccaacttctgtccctgctcacagattaaatcactcatttctaattgggatggaaagctcctgcatgggtgccactgtgaatggcattgtttttcaactaaacggatcataactgatcaggaagggttctccacacttccagtgcttcccggaagcagccagtggatgccaggttgcgggggaggcttaaagcaaaggcccctagagaagccgcaagagggtttccagggccaggtcagaccgtgttaccataccccatgcacatgcggtgtgcagcacagggcaggctctcagcacacacttgctgaacaaatgaggggggtgaattaatgaatggagggaggaagcaggagcggacatgggaaatgcagagaagactcacattagtttagccaggcaagatgaccctcaggtcccagaacacgctcctcactggggaggacaggcagccatttcgcagaagagacagcctgaggggttgggaggctggctgcagcccatggcagggacaggccagagcccagccttctgcctgggcttggatgggtcattgtcaggcccccagccattctgccaagagaactggggttgggggaggcttcctatggtgaccccaggaaaggagccacagctggccctgggggtggcccctaaacccctgcctgggctaagggatgggagagtaagcttctgcctcatcccagggcagagggtggctttgctcagggagcatcctgcagctgggctactgctcctaattttcacgccttgtgtgaccccaccctcgccagccctccttgagggcagtggggcagctgagcctctcccccatgctctggggctggtttggtggaggggaccacaccaaggggctgtggatgctgaagcgaactcccaactctacttgcagcatagctgacaccgcgtgatgaagccaagagcgcaaactgaggcctggtcaagctggggagagggcacaggagacagaaaaggattctttcagagggagtgggagcgggacagggaaagaggaaacagaagcggatgtggagaaagaataatcccgccccaccgaggactgtggggtgctatgggctgctccacagggtgcatgtctgtgcacgtgtctgcgagggcacctgtcggtgtctggcgtgtgtacccagagtgcaaaggtggcatactcaggcgcactcgggcaccccctgcaagacagcagagcttgttggaatctctggaacccagagcggggaggtgcttggccttctttgctccggtgagtccccacagaccctacaggcctgtggcacaggcactgaccaaccaggccacagggagttgatgagaccctgtgacacctgaatgcacctcagtgcacaggtgcctcccaagcatgccctgtgttcattcccatgttggcctttcagagaggaatgttctacccattttacagaggacagggggagaccagtgagatcagttttctagtcccgtattgccacaaatgggaggctgagccaggaggatcccttgagcccagaggttcgaaaccagcctgggcaacatagggagactctgtctctacaaaaaattaaaaagtagcctggtgtgatggtgcatacctgtagtcccagctacacaggaaactgagacaggaggatcacttgagctcggggagtcgaggctgtagtgagctgtgttcacaccactgcacttcagcctgggtgacagagcgagaccctgtctccaaacaaaaacagtaacaacgaaaagagactcctgggctgtgctgcaggctctgggaggaagcagcagaggggcctgggctccgagggctttgagaccctggagaggacctgggagtcaacacctgtcctcctccttcacttgctccaggacagggtggaagtgtaggcatttgggcttcagaggccaggcggagtctggagcaaccccaggcagcagagtggccccactccaggaaactcctccaggtgagcccacaactgaccacaaggcttgccctgcccccatgtgccttgggcagaagaaacagaacagtcacaccggtaaacaggaagtggaagggcgaggaggagcccagtcgtgagtcactgtaatttaaacacccaaggcagacaagtagcacaaaagaggaaaccaacacatctcatggaaaacacattcagggacccagagctaatacaacaaacagaataagactttagaataagtataattaatatccacagagagatgtgcgtaaataggaagccagaacatattccactgcaaatcttgacagcatccagattggaaaggaagaggtaaaactctctgtttgcagatgatgaaatcttgaatataaaaagtactaaggaacacacacacacacacacactcacagctaatagcaagttcagcaaggctgtaaggtgcaaggtgaatatgcaaaaatcggtcatattctatacactagcaatgaacaaactgaaaatcaaattaagaaaacaatataatttggagggacaccataacaaaatgccaccaattgggtagcttatgggtagcttacaaatatattgtctcatagctctggaggccagaggtccaaaaccaaggtgatgcagggttggttccctcacagaaggccgtaggggaaagctctgtcccaagcctctatccttatttctgatagctccttggcttgcggcagcaaaaccccaggctccacatgcagttctccctgtgtgcctgagcctgtgtctgtgtccaaatttcccttttaataaggacaccagttacattggattagggcccaccttgttccagggtgacctcattctaagtcaattatttgcatctgtagttaccctatttccgaatagggtcacattctaaagtactaggaagtgagacttcagcatatgaattttggggagatatagttcaacccataacaaattctgttcacaagggcatcagaaagaataaaatattgaccgggcactgtgactcccagcactttgggaggccaaggcaggaggatggcttgaggccaggagtttgagaccagcctgggcaatatagcaagactctatctctacaaaaaatatatacataattagcttctcaggaggctgaagcaggaggctcacttaagcccaggaggttaaggctgcagtgatccgtgttggcaccactgcactccagcctgggcaacacagaaagaccctgtctcaaaaaaattaaaagactgaaaatttatgaataaatttaacaaaagaagtgcaaaacttgtacactgaaaactataaacacagttgggagaaattaaagaacacttaaataaatggaaagacatccacattcatggattgggagacttaatatggttaagacggcaatacttcttaaagatctctgggttcacagaatccatatcagaatcccaggtgaattctctgcagaaagttacaagctgttctgaaaattcatatgaaaattcaaggaacccaggatagttaaaaaaatcttcaaaaagaagaacaaagttggatgactcacaattcctgatttgaaaacttactacaaagctacaataatcaccaggtgtagtggctcacagctacaatcccagcactttgggaggccgaggcaggaggatcacttgagtccaggagttcaagaccagcctggtcaacatagggagaccctgtcactaaaactaatttaaaaagtagccaagtgtggtggtgtgcacctgtggtcccagccacttggtaggctgaagaaggaggatcgcctcagccagggaggtcgaagctgcagtgagctgtaatccagtgccactgcactccagcctgagtgacagagcaagaccctgtctcaaaaaaataaataaaataaaataaaataacttttaaaagaacaccaaaacaagccaggcttggtagtacatgaccatagtcccaactacacagcaggctgaggcaggaagatcacttgagcccaggagttggaggagtcgtatgcaatgatcacacgtgtgacaatagccactgcactccagcctagacaacacagagagaccttgtctaaaacaaacaaacaaacaaaacccaaatagaaattaccaaccacttagaaatgggtgacagaacagaatattccactttttaaacttgtgaaatgtttcaaagcaatatccacagaaaatgtagaagccttaatacgtttattagagaaaaggaagattaaaaataaatgaactactatcttagttcaaaaacaggaacactaacattaaaataacccaataaagttgaataaagtgattgatagagaaaaaagcaaggctgagtgcggtggcttatgcctggaatccccctacccctcacctgtgaggaggtggatggatcacttgagcccaggagtttgagaccaacctggacaacatagtgaagccctgtctctactaaaatacaaaaattagccagtcgtggtggcgggcgcctctaatacccgctatttgggaggctgaggtgggagaatggcttgaacctaggaagcagaagctgcagtgagccaagatcgtgccaccgcacttcagcttgggcaacagaccaagaccctacctcaaaaaacaaacaaacaaacaaacaaacaaacaaaaaaacaaaaatgaaaaaacagagaaaaaagtagaaagtcatgaaatagaaataaatgggaaaattagaaattcaataggaaaaaaactcaccctcagaatggagtgatgctgtgagtttcgatggaagcaggtgaggctcaggggtttgcatgagcgttcccaacctgggtagtgcaacttgggcagacggtcaggagaagagagaaaacacagacagatgatgtggggaaagatgaagtgggtgaaggaaattagtcttcgtggcccaatatgtatgaggaaagctttgaaatcataggcatcatggaaaaatgtatggaaaaaatacaaattatcaaaatgagtgagaaaaccccagtagacttaagaactacagggaaggaaatgaacaagagaacacaaggtttatcgtaaaatgcagtgtcattttttcaggcaatgtgactttctacactgtctagaaaattgaactaacaaactataagaataattaggacaaattcaactatgtggcaagatctacacaaagccctcctagctatcagcaatgatgaattataacatagaaaagaaaaatgtcattcatgatagcaacactgttacagcacatagaggggaagcccaacaaaaaatgagcagtaccaatgtggagaagactataaagtgtagcatgtattgcacgaatagagatatactgtgttcctcaatggaagattgaacatggtacaaatgtcagttttcccctaaattagtgtagaatttaaatttggcatcaattacaatcaaacaggatttccgctataaaactgacaagccaattagaaatagaaaatgtacaaaaaaagacaagtgtgaaaaagagaagaatgcagcagagattctctgtgatacacaaaatatgcaataaatgattttaattgaaacaatatataaaaataaacatatagccagcctggacaacattggaagaccccatctcagcctaaaataataacaataatagaaatcatctaggtgtggtggtgtgcacacctgtagtctgagctactcaggaggctgagacaggtggatcgtttgagcccaggattttgaggctacagtaagctatgatcacgccaccacactccagcctgggcaacagagtgagaccacctctaaaaaaatttaaaaaaataataataaataacattttaaaaaagaataaatatataaaatactcactttaaaaaagaacagtgtcctgaaataggcccatgcatttagtaacttcctataaactaaaagaatgtgaaaatataggctattcaaaaaatggttctgggttgactcactatatttgtaacataagatagagagctatctcacaacactcaaacaatccagatgatgtattaatctaaaccattgtaagaaaattataaaaccttcaactcataaaaaaagaaaattataaaacttaaagaaaatatgcaaaaatataagtgaagaaaatataaaaggatatatattgaggtagaaaagtcatttcttttttgagatggagtcttgctctgtcgcccaagctggagtccagtggcgcaatctcagctcactgaaacctcccgctcccgggtgcaagcgattctcctgcctcagcctctcgagtagctgggactacaggtgtatgccaccacccccggctaatttttgcatttttagtagagacagggtttcactacgttggccaggctggtctcgaactcctgacctcaagtgatccacccaccttggtttcccaaactgctggaattacaggcgtgaaccaccacacctggccagcagaaaagtcattcttaagacatgaattataaaagctacaaatgaaagattaatacatttgaccacatcaaatttaaaacaaaaatgttctatagaataaaagacactaggcaaagcaggatagctcacacctgtaatcccagcatttagggaagttgaggcaggcagattgtttgagtccaggagttcaagatcagcctgggcaatataccatctctacaaaaactagcaaaaaatagctgggcatagtggcatgtgactatagtcccagctactcaggaggctaaggtgagaagatagattgagcccaggaggttgaggcagcagcgaactatgatggcaccactgcactccagcctggatgacagagagagtccctgtctcaaaaacaaacatacaaagacactaattgcaaacctaaaaggcaagttacagtgtagaggaaacattggccacagctataccaggaaaaacaatccctgatacacgattaaggaaaattcaacaactaagtagggagaggacataaacaagcaaatcaaagaagaggaagcacaggcaactgggatccatgaaaacatgcgtaatctcaagacacaagacacatttttcactcgtcagtttggcaaaaactgtgaattatgaaaatgtttaggattggtggggtgtaaataggtgcagcatttctggagggcaattcgtccatagctactaatgtccccagtgtctagcaacatggaaaagtgtaaataaatgatccctattcggcagtttagaaatgaggtcgtcctatatgcattaatatggattacattgctaagtggaaaaagcatgtcacagaagcttgaatccatgggacacttttcatgtcatccatttgtgttaactcacagatgaagctcaaattacacaaaagtgaattaagcagaagccctcaggagggacgtacactggagggttgccctgtcatctccagggagggccccaggcttggtagcggagagcaggtggcctcacgaggactgctactgcatttgaatgatctccctgctttaattgacagaacaggtgtgtgtattgtgcatacaacggattcctgtgctgtcttctcaggtcacagaatcccagggagacataaggaagaggcgaggactcaaatgctctgccaatcattgggagtaacttgtccctagggcagaagaaagagctgccctcttctgtccctaaaaacatgtttctcttccttaataatatcacggggtgggggggagcagggagagagagactgagcaagagggaggcgccggagtccctttctgattctgagacagtaatgcccaggttttgcacaccatgctgtccactttgccagcaggactgggtggcatggcacttctgatagaacgtctgctgtctttctccagattccattctgtgcccttctgcgaggtcgaagctggtgcttccttgatcataccagcaggtgtcagcagaatgttctggacaccatcccagacgctggcttcttcctcgtggtccttcagtggtttgttggaaacactgagggctggggtcgtccagtcaggttccaggtgaaagtgtgcagaatcacctgccgcccgcccagctcctgactctgaagtgctgagagtgaacacagcttcagaacagatgaaaggcactgcttctctcccatcaactccacacacccagtgataacagaaaagggcagtccagtcttctagtcacccttcgatgtgatggggcagctgcaacccaattttagatgctccgagaggttaaatcaattccccagggcacacagccataaacggcaaagacaggacttgaagtcgagactgtggttctgaatagtgccctgtctacactacatgaccaagagggcatttctggagggcttgaggttgcgtgtgtcaacccctgtgaatcgcagggtgaccaggagcaaaaggcttgccacagctgagaccccccagggtcttgctctgggccttcccctccctggaccagagcagccccatctatgaaaagatcatgctgtactctagggtatctgagagcccccgagcaccacggctccatgactaagaaactccagaaaaaaactgtgaagtgcggcttcacttctctgcatctggactcaggatgcgcctcgtccagcctgaggaccctggacttcatgcctggcaaaaggctgtgccactgaggtttcctgaaataacactgcccaattcggggacatgccctacagtcctctggatccagggaacacctgtgagcaacagcctctgggcttggacagccgatcctgcccctcatgtggacggctggcccactcccccaaagtccccgatcctagagggagagacagaaatggggaggtctgggtctgtccagcaaccaggataggcacctccttcttgatcctggagacaggctcagggggtgagcacagaggggacttcccagggtcgagaaactgcttccggtgaggtgagaatggatagatcacctgaggtcctgtggttaccccacccacccgacctgtggtccccctacctcctgtggtgactccaccccttcctgcatccacccagctcctcctgtggacacaccacatcctcctggggacatctcatccgctcctggggacaccttaccccctcctgggatcctctcaccccctcctggggtcatctcaccccctcctggggacatctcaccccctgtggtcacccaccccctcctggggtcacggtctccccaccccctcctagggtcatctcaccccctcctggaaacatttcacccccctgtggtcacccaccccctcctgggaacatctcatctcctctgaacacctcaccccctcctggggtcacccaccccctcctttggccctccttgccactttcactgacctctcaagcccgcagcctctgtgtggtcccctgagcaccccgaatccctgtacctataggtagagctggactccagggcactctggcttcatcccctgctgggctcagccctgagatccccccggaggactgcagcaaccctgagttgctgcttgcctggccccacagctctgtggagccgctcctctcctcctcacagggctctgaggagggacctaaaaggcgagtggacagccagccatggagggtgccacttgctgggagtccctgccatccctcccggctattgggggcctgcctcccctgttgacagcaggctggggatgggatgagctttggcaaggaggtctgagtggccatggcctgggcacccccaggaagagctgaggggccggattttgggctcccttcactcctcacctcccacaagccttgcaggtcccatttgtggcttctgcatcctaaggccccggctgaggggactcgcagtagacggtccatgtgggtaagaaatagtcctctgggtcacagtctctgagatctgggccccttcattacagcagcacgtcttagcctgagtgggctggtgtcagacacagcgagtggcggtaagtgtgggcccctcaccatctccccttcagggatgaagagggccttgtgccagcaaagtgagtaagaaagagcagtccctcaagaggagagcagggaagggcaagggatggccgggccgagggcagtggctgggagccaccgaatggaaaggggcgggcagtggagggggcggtcatgaggctgggagctgtgccagtgtccagcaggccgcacccctccgcctcctctcacccctcacaggaaggtgttaatccatacatccggagacccagagaaaccaagtaacattgcattcctggctgtgtttcttttttattttctgttttggggattttgtttttggagtttttttgagacaggatcttgctctgttacccaggctggagtgcagtgatatgaacatggctcactgcagccttgaaccctggcctcaagcaatcctcttgccctcagcctctcaaatagctaggactacaggagcacatcaatacacccagctaactagtattttgtgtacagctgggtctcactgtgttgcccaggctggtctagatctcctggtgtcaaacaatcctcccacctcagcctcccgaagtgctaagattataggtgtgagccaccacgccaggcctgtgtttcagtgcaaaataatatcattacatatctttcaaatctctccagaatgatgaacttttgcaggtgcctcatttgatgaggtcaaggatcccatcttagatatgcaggcagaggccatgccagctagtacaagcctaaggcatgtagaggtagacggcatggccgagggatcatagactgggtgcactggtcaggagtgggtgaagtaggtagagcctatgggggggagggcgcagccacatagagaagtcctgtgtccccactcctgccccaggctcctccacaggtgtcccagcaatgggcaggttggtaagagtcaggctgggctttttacgaggagaggtagagacatcttcgtggccttaccctggaggagagagaccaccagctggtgagagactgttgtgctggtactgctggggaagcctgcactccacctagcgttaatgagaatagtgtctccttggaggcacagggtaatctcatgggggacaattatctcaacaaacgtgaagcccagccacagagatttgagtggaaggaacacagatttctgctcctgttaatttcatgcttgacttaaccgtccttacgtgattgtggcactggtgacagtgcactggaaacacttcttactcttcttccccagccaaaccttctctttctttgtcccaaagatttgaactcttgcttttgactcaagttccctgtcttagagattcatgggcatcattgtgggaacatgtttattttgcctctcctggctgggtgtggtggctcacacctgtaattccagcactttgggaggctgaggtgggtagatgggttgggcccaggagaagaccagcctgggcaacatggtgaaaccctatttctgcaaaaaatacaaaaaattagttgagtgggtggcacgcacctgtaatcccagccactcggaagactgaggcaggaggattacttgagccaaggaggttgaggctacatacagtgagctgtgatcacgccactgcactccagcctgggcgacagaatgcaatcctgtctcaaaaacaaacaaacaaacaaaaaaaacctataatagtaggtgctcaataaacgtttatgttttaaaaaggaatatcatgatcatccacacttttagaatgatgaaattgaggcttgggagagtaggatgtttgcccaaggccattcagtgcataggtggcagaacaggagtgggaattcagatccctcagaccccaaaagttgaaatctgcctttgcaggtgggaataattccacccctcctcaacagccacattggactgaagatgggagttagggaaagaggcatttggggaggacataagtaagaacttgtcagcaggatgggctacatggttttgaatagactgtgatttaggctgcacattgatctaggagctcttgattgcatttccaaaggtggtcacgtatgctctttccacggtatgacctggatacacctccatcgagaggtggagtccaagtccccaccccttgacctgggtggccctcaataactgccttaactcatagcgtatggcttctgagacacaaggccacacagctttgtcgtgggcctctcttggggcaggcgccttgggatcaactgcaggtgtgaagcctggctgccctgaggccaccatgctggggaggccacatggagactctgccagagatagtgatgcaaacaccctctgaggcgggaggatcacttgaacccagaagttcaagaccagcctgggtaacatagagaaacctcatctctgctaataataaattagttgggcatggtggtatgcgcctgtagtctcagctactggggaggctgagatgggaggatcgcttgagcctgagagacggaggctgcagtgcgccgtgatcaagaccctgtctctaaaaacaaacaaaaaaatcctttaaaatactctctcgactctatttttcttgtgcctctttttgctcccatttccaggaaaatatgctcaaaaattcatctactttcatggtctatactcactcccatcccatcactcttgaatctattccaaatcatttcctcaaccaaaactggtcttgtaaggcttcagtggcctccatgacagccaattcttttttttttttttttgagacggagtttcgctgttttcacctaggctggagtgcagtgttgcaatcttgcctcactgaaacctctgcctcccatattcgagtgattctcttgcctcagcctcccgagtagctggggctacaggcatgcgccactacacctggctaatttttgtatttttagtagagacagggattcaccacgttggccaggctggtctcgaacttctgacctcaggtgatccacccaccttggcctcccaaagtgctgggattacaggcgtgatcccacagcctgtgggattacccagcccacagcagccaattctagaaactaatccttagttttctatgatgacgtagcctatcatgacctatctgtatgggctcacccctgccttcctaagcccctccttcccctatgtcctcctcctccacagcccctcctcggcctcctaacctgtcccaggacacccctgccctgttccctcccctcaaccccctttcctggttcccccacctcccactggcgtgcccaagactcagtcctcggctccgtgcctccctctgcatctacctactctgtgatctgtccctctctggcactgcagacacagtgtgggtgctatcaggtccagactcatacgtccaacctgggcctcgctggctggaaccagaatcccagccacctttgggtgatgatctgtggccgactgccactgctactacttgagactgtcactacaacaattactactgttactgcctaagactgtcattacagtagttactactgttactgcttgagactgtcattacaagacgaacgtagaaatgataaaagacaaaagtaactattttaaggaaaggctagcatggggaagaagaagagagaagagaagaaaagggctctctgcttgtattaagcaaaggcagccgtctgagcttctacagcccttcgtatttattgggtaacaacagcaaggaggaggaggtaatgattggtcagatgcttaattgatcacaggttcatattgttactaacaagcttcaattatgtctaatcataagaaacatttgtgcagcttccaacatctcctcctttttgtttttaaattaattgagcaaggcaattgcaggctgtgcagcccttaattgcgagttggtgatccagcttcatttttcttagcccttattcaaaatggagttgctctggtttgaatgcttcttacatatttcccccttccctttaacaagaggacccttaatcctaagggttgcagaaagatgaaggtctctcttctgcaacttcttcatgctgaacaggggcgaaaatattcttgcctattaggttctcttgtattcagggtagagaggagctcagtcagaaagcattggtccattaaggtacaatcgatggattgtacctctgagttccagcacaaggtaaaaccctggcactccagcagtttctcagcttcctgtgtggttttcttgatctgtccccatgtcacgggggttggtgtcagcgtgactctggttggtcctcgttctgttttcgcattcagattcaactggctcattgctcatactgggggaaccaggcctgtagttggaatccatgggtccctccagtctccctttccatggttgcacacatcttgacggcacccacatggtttgttcatctcctgcaaaaacacaagcataccctcgaccccacattagtaaatctgtaaaagcaaaggtttttgtggctgtagccaggaggcatgccactgctgaagcaattgtaactcagcttctgcctctttagtcaattgccatggggtaaaactttccactgataatgaaagacaggctctttctgattaacagaagacacggaaaaagcaaatcgaggcttatccttctcataaacaatcctcaagatctattaccacaagagaccagtctcttgctcctgtatccataagcccacaaaacttattttcttcaatgtacactgcacaattgggtctatgagatgctatgggttgtgatagataaatttatctcctaattatacctccccaatccctgatctccttacttcttacttagagaagggtacaatttacaggaaataagcaacaactgagcaatacgctctcctggttcaaaaacccaaagatcttgtgacattaccactacctgaatttctccttcacaatcaaaatcaacaactcctggacctctaagttaagatagcttttaccaaaatcagtcccatgtatattgttggcaaaggtccccaaataccaacgggaatcttagtgagtttgtttctttcaattaacataattttttctctaggagagctaatcctgcatttccaggtgttcctgaggagagggaatcaatgtgcctctggaaacccacccctgaaacggagttgtggcctggacggggaatgccctcatagtttgaagtgcctgggtccaggtccccttttcgcttcccgtgccattttgatgaaattttgagtggcattgattagcccaatgatttcctttattgcaacgagggcaaagtcctcatgttttttctgtggagaggggaaccgtgttttaagatcccttctgcccagaggtctggcggtgttcttttttgaaacatccaatttttctacacttgacattgtgtaattgacattgtggacctcccaagtagaaagcaattaagcaccagcggtagaacacaggttagtcttaagaccacgtgattaagcaagttagttagataaactccctacactcctttgtttctaccctaatttatttaactaaaggtaaagggactaggctgccttcagccagatttattaccgaagttatgcaaactctcaggccttccaagagggtttgtggctattataactaaaatttttcccaccagcttgactgaacccccacatctctcccttttttgttttctgcatcaggtcttttgcattggagactgcagatgtgtgcagcaacaggtttgtcgggcatggcagtcattgctcttattccagctttgcatcctagaattagcaaataacataaaacaatcatgagtacaatttgcaacattcagttccagtcagagtgacctccaggagtgggggtctaaccaggagagatgattttgcacacctttccatatggctgtttgttgggtgtgtagatctatggtgtgaggggattctaaaatttttgttttaagttgctttatgtctgctgttaaattgtcatgaaaggttccccagaggtgttgtttcacctcatctcaactatgtatagattgattctatggtagagaagtgacacagatatgtttatgctcccagtcacagtttaattgctgtcggaatgccagtgcatcttgtcgctcccccacgtattctaaagctgccttgtgggcttgcagacgtgcaagaattttttgatctataccttgctgtaagacttcattagacacatttttggccagattatctacaaaggcagctgtttgtactgactcagtaatagatgcgagagcaacgcgagcagttgccaggatgactatggctgagactataaaagccataagtgtaactatgaatcttttgtgtctgacgtgggatagggtacgttctacattctaaggtgacaaggacagaggaaccttgccaatcatgagtcagattgactggtaggaatgcctcagattgtctccttaatatcacgacactagtaatttttaaattagatatattgtggtgatacatgaggcaaaccaagcctgtccctgcacccgggtcacaaacgtggagttttgaggtgtaatggaaatgttagttcccataaggaaaacatatggatgggtagagcaaatcaggcactgatcagtgtgattatgaataaaggttatggtatagttgcgactggatttatgacatgtcccatgccaggtgttaagggaggtgctaagatgtcccaggtgccataagtttcactggggtggcatggactttacttagggtctgggatatctcatccccccatcagcccaaattataggggaacgagacgtggctttgaaactgtgattgatgctgtgatggatgaagacattagtaaggctgccctacaatcggccatgggggcaccagtctaagatgttataattgcctaactggaggctatgggcttgtctcctgtgacagacctcccagctaaagtggaatccattactttcctggctttgttctttagcacaggaaggaatgtttgggaaagcggtgttgattgcattgcccagtttgaggcttcctgcagctaagaatgctaaggcatttccttcacagtgatgtagccatacttgttttggggcaggtacacagtaagggttagagcctttataacttacacacagtgggaggatagtggagtgatatgtaatgttatctggcatcttagtccaatgtgtgccattattgcgggacctcactggcggtaaatctattcctcctaactaagcagtcacgttattataggctgggaagggagcgtctgcccaggtgacagggcaaaagaaaggtgggtctaagatatgagtccaatacagtgtagtagcaggtacaggttgcagacaaagtgagagcataaaaaggattaataccctatatgagatgcaatgtacaacagaaagcatagcaagaaataaattatctggagtaaatggtgtttgtgtctggagcaggattcattcagcctcctgaattgtcctcttcagcatcccccaggtaacatccaggactcacgtcatccgcggaagccacattgtccagggctgtgggtcttgcagggttaactcctttatttctggtaccggattcggtcctagctacaccatggtatggtttgatgcatcatgctggaatccaaagaggacctgagggggtgtggacacaagcataccctcttccccacgttaataattcatttggaccacaccattcattacagttcacatctttccataaaactgctggttttatgccttgagaggttttatcaaagtgcttttctacagctgattgaatgaaatttgtcatctaaatttttaaaattaagggtaaataaggcttgtgccaatagtgttgcagggtctttacccatactcctccttttttgttttttgagcatatttttaacagtggagtgggcacattctactattgcttgtctttggggattatatgggatgcctgtggaatgttggatattccacgtgtgacaaaattgttgaaattgtgaggtggcataagccggaccattatcagtcttaatttttgcgggttgtcttataaatgtaacagttaaaagatgtttaatgacgtatcgagtggactctctaagcagagcatgtgcactaattaaatgagtgttggtatcaatggatacacgcacatatcttagttttttaaatttagggatgtaggtaacatctgtttgctataactgattaggttctagttctctagggttaacacctgttgaaggaggggacatgcctgtgagctggccatctgggcattgtaggataatttgtttagccagtctctgtgtaagttgaaattgtttagataagtttgtccaattttggtggaaaaattgatgtgattgggtggcttggtcaagcagtgatgtcataacctgaaggtctgcttgttcattgccataagccaatgggccaggcagtgagctgtgggcttgaatgtgtgtaataaaaatagtatgtatatgttgatctagcaattgctgaagtcaaagaaaaagagcacacagggctggctccagagtagacttaattagtgctgtctcaaggttctgtagtaaatacacagagtaagcagaattactaactatattgatgggctgagttgaaaaagtttctaaggccagtatcagagccctaatctcagctctctgctagcaaacagattgagtgattgaatttggtctgtactagactgccacttttctgtttactagacccatcagtaaacagtgttaaagcatcaggtaggggggaatgaactatttttgtaggtaaaatatttactagactttttgggaatgacgaaaatgggtgaattttaagggctgttagaatattatccataaaatgaataatcttgcaatcaggaaattttttttcactagggagcagagcttgattttaattgctccttaactaactcatgggacttttgtaatttctccccctttagaggttagttttgcttaaattggatttggagagtcacgctaggggtaagagaaagagaacagtggccattatcagaaagaggtttttcaaatcttaaattttacttaaatcttagcatagaattatactttgggatgtcgctcctctacaaggagcactcgaaattttgccgtgggccgcctgcggagctggagagctgaggaggcgggtcctggggcagcggcagcgttaccgcttgcaaaggcgccccttttttctgtgctgattttcgcctgtgagacttcctcccacgggcgccgctggctagtcagactttcccgcgtgcctcctgccccgccctaacaggctaacttttccgcgccgggcctggctctttgctgcagctgccgccctcggtgcagagttcccgggagcacttgctggcttcggtttcgcgaacttcctggccgcggagctttcccttctacttaatgcttgctagctcggccgcaccgctccccgccccccgcccccgcccccgcccccgcccccgggatcgggcctctaatgccttttcttaacaccttatgtagctgattgccttgccgatcttgcattacgggcagactaagggccctcttaatgccgcttgcctaagacaaggtcccatagctggagcatgtttcttgtcttttttcctacttattggaggagggggctcaggtgaaacctccctttcctctttgttattttgccccggtgatactggggctgagggaacacaaggcgataaggtgggtgacagttcctcctctttcccctttttaggctcttgcatgtataatggaagcagggctgctctaattaaagcccatagcgttaaagctgttactgggacctgtttcccttgtgcataatgttgtttaagatttctccccacaggccgggcgcggtggctcactcctataatcccagcaccttgggaggctgaggtgggcggatcacctgaggtcgggagttcgagaccagcctgaccaatgtggagcaaccccgtctctgctaaaaatacaaaattagctgggcgtggtggcacatgcctgtaatcccagctactcgggaggctgacgcaggagaatcgcttgaacgtgggaggcggaggttgtggtgagccgagattgtgccattgcacttcagcctgggcaacaagagtgaaactccatctcaaataaataaataaataaataaataaatatttctccccacttgttcccacagcttcatgtttagtgtgcctttttcagggaaccatgggctttgggattcaacagtttgcattaagtcctttaattgagcctgcaaaactgatggtctgctagcctttagcaactgtttcaacacttttatatactgtttctgttgagctgataactgttgtcccatgatgaaatctcagcatgaacaatctcccccgaacttggaaatcccaagtgggcaccaatgacttactgattactcactgaccacgtgtttcctttttcaccttcctttctcgggtccgttctgcttccttcccagtgttcatcacgtgggggcaccggctgtgggggtctgtcccgcagaccctgacccaaggatggatgaataaagtacactgatacacagatactctgctttgccagtccagctgagcgtctgggcagcttacagactacatgcaaagtgccgcaaacagttgccactgcggccagaacagctagtgagactcgcatttattcagtaaagattaattgacaaaggcttgagtcaacaccactagagggtaattgacattgcggacctcccaagtagaaagcaattaagcaccctcagtataacaaaggttagtcttaagaccacatgattaaacaagtttgttagataaactccctacactcctttgtttctaccctaatttatttaactaaaggtaaggggactaggctgccttcagtcagatttattactgaagttatgcgaactctgaggccttccaagaaggtttgtagctattataactaaaatttttcccaccagcctgactgaaccaccacaactgtccactaccatgaccaagagacacaggcagctgatggacatttgaaacgtggctggcccaaatggaaatgtgctggagggtaaaatacacactgcattttgaatgctttgtaagaaaaaaaaggatgtgaaatttctggttaataactgttatatggctgagcgcagtggctcacacctgtaatctcagcactttgggaggctgaggtgggaggatcacttgagaccaggggtttgagaccagtctgggcaacaaagggagagtccatttctacaacagcaacaaaaatattagccaggtatggtggcacatgcctgtgatcccagctactctggaggctgaggcagaggtttgggaggggtggccagcttgtattcccttatttgtccccgcccacatcctgctgatggtccattttacagagtgctgattggtccattttacagagtgctgattagtgcatttacaatcttttagctagacacagagcgctgattggtgcgtttttacagagtgctcattggtgcgtttgcaatcctcctagctagacagaaaagttatccaagtacctgctggacccagaaagtccagctggcttcacctgtcactaggaaagctgagtgtgcatatgggctccacacgctgctggactctgtggcccctaggcactctggggccacactaggagcccccagacagggccctctgctcctggttgagggcagggtgtcaccccattcctcaccaggagggctgcatctctagtgtagcctgccagcctgcagtgccatcaccctagcttatggtgatgacgaggctgagcctcctgaaaggtctgtcaaggggcagcagaaccccccgcagacccagctgctgggccacggagcctccccactggccctgccagccatgctgggacttctcacctgcgcctgacctgctcctgggagggggcttcttcacctccctcccgcataaaattccgccagttttggccaggcatggtggctcacgcctgtaatcccagtactttgggaggccgaggcgggtggattacctgaggttaggagttcgagaccagcctggccaatatggtgaaaccccatctctactgaaaatacaaaattagctgggtgtggtggcacatgcctgtaatcccagccacttgggagactgaggcaggagaatcgcttgaacctgggaggtggaggttgcagtgagcaaataatcatgccattgcactccagcctgggcaatgagagtgaaactccatctcaaaaagaaaagaaaagaaactgggccgggcacagtggctcatgcctgtaatcccagcactttgggaagccaaggcgggtggatcacctgaggttgggagttcaagaccagcctgtccaacatggagaaacctcatctctactaaaaatacaaaattagccgggcgtggtgacacatgcctgtaatcccagctactcgggaggctgaggcaggagaatcacttgaacccaggaggcggaggttgtagtgagccgagatagcaccattgcactccagcctgggcaacaagagtgaaactctgtctcaaaaaaaaaaaattcatccattttaggtgtaaatcaataatttttagctaatgcatgcagttgagcaacgctcaccacaatccagttttcagacacttccatcagcccctgaccccatcgcgacaccactttccgtctctgtggatgtccttctctcagcacttgaggcaaatggaatcagatcatatgtggccttttgcgtttggcttctctcacttagcatgaccttttaaaggggtgtccatgctgtggcatatttttttaattgcaactgatttcttcctctcagagaaggcagctgcacccattcctgaacttgcaaaagaggtgttttaatttggggggcagaatgcccctcttcctgcagcccattctgaacctgccctcccctgccctggtcagcacacctccccttgtgcacctggagatcgtcatactcttcagatctgattctggagaggaaaggaaatatcagctctgtgtcactattttcaatggaaagaccatgagacatctgctccccagcccagtcccttgtcctgcactgacatctccaggtgtggccctgggcatctgcgtgtttaaaatgcccatggtggacagagttgacaatggaaactctgctttctgcttaactcttacattccctcttattttttcaattgagaactaatctttgatttagaaattatgacattcccaagttctactccaatctttttttcgtatttatgtgtcacatgtggcttatttaataattctttggcaattgtacatctcagtctcacaattggcctgatggattaacattttgtttactcaaataattgtgcttggatgataaattagcctgttaacacttctttcttagcaatatgctcactgacaataggcttctttcacatggctgtgtgctcactgcatggatgggatggaatccaaaggtcccatcctcccgacccaagcagcgcacgtggtttcccagtaatctctgtgacgcaaaacctgagagagggaacggcccacaacatgcagtgtcctgagtggacacttttccaattctgttttgccctgttttggtcaaggagtgtgtttgcgcatgcatagaaagagggagaatgtgtgatacacacacgtatgctatttaggtactgacaccaagggtattaaacacatattaactatagaaaagctgatgtttggagctcatctttctgcctctcatgctgcctctaggaatcccctagggtacggaggtggaaacaaacactttcctgctgtgggaacaaccacggtgttgagtctgtcccacctcctttcctaaagccagcctgggcatgcccacaggggcaggggtccccgatgaagggggagcctcatggtatgccagagcaaaacgcaggagacagctgtttcatttggtaggtgttctccatacatgattacaacacctgcaaactgcggctaactatggcacagtgatgtgcacatctgatcccgtgcttgattttaaacggaatgctcctaaagtcttaaatgtggcagttgcaggtcttggtagataacctttaacaagaaaaggaagttcccttataaatgtagtttgcaaagaggttttgtctctttgtttttctttcatgcatccaccagatagatcatgctttgagggcttttttgtggtactttaaaagcactgtactctggttttttgggtttttttgtaggtttttttgagacagagccttgctctgtcacccaggctggagtgcagtggcacgatcttggctcactgccacctccacctcctgggttcaagcgattctcgtgcctcagccacctgagtagctgggattacaggcatgagccatcataccccactaatttttatattttcagtagagacagggttttgccatgttggccgggctggtctcgaactcttgacctcaagtgatccgcctgcctcagcctcccaaagtgctgggattacaggtgtgagccactgcgcccagcagcaatgcactatgtttatttttatggcggttgtccttaagatccacacttacatttatttacttgtatttgtttcataaatttaacagttgtctatttcttttctgccacaaaaagaattttacaaattctcaagcccctccctttgtctctcacccctgtatgtgctctgcctcactgggaaggtttcatgtatacttacgatgagcaggctcacagtgctgtctcttagcctgggtattatgtaaagagacacccattcctctgagaatgaagaaagagaatttcagtattttggttttttcttttctttttttttttgagacagagtctcactctgtcacacacgctggagtgcagtggcgtgatcttggctcactgcaacctccatctcccaagttcaagcaattctcctgcctcagcctcctgagtagctggaattataggcacctgccaccgcccctggcctttttttttgagaatgggtctcgctctgatgcccaggctggagtccagtggtgcgatctcaactcgctgtaacctctccctcctgggctcaagtgcccaggaggggctcaaggctgaggtccctcagcctcccaagtagccgggaccagaggcatgcaccaccatgcttggctaatttttcaatatttttgtagagatggggtctcactatattgcccaggctgatcttgaactcctgggctcaggcaatcctctcgcctcagcctcccaaggtgctgggatcacaggctgagccctcgccaggcctaaatgcacatttctagctctgagctgtctgttgatggcctttgccaattccttctcattttcctttttagtgtctgttacgtaatacttgttgattgtagaaattagaaaaaacaaagaaactaaaaggtagaaaaaagtgtcagtcgcctaaattcccaacatagagccacattacatgtttcactctgtggcgtttcaggtttctctcagatgttcaccacatagacctgatgtggaaattgccacactgtaaatggtgatgctacatgttcagacattgagatgacctcataaatttccttcaggtattaactttaggaaatgctccttacataaaccccagtgctccaatgttgacatggaaagagacattcagagtagaggaacagctttcattgaaatcttgattttgttctcaaattacccttagggatgacatgatcccttccaaaccagcacagacacgactacagtccattctcctctgctggatgtagtttcaggattttcccatctttatttctttttaatatttgagaagcataaagatttgcttatgagctcttagattatttaaaattatttgttgtgttaacagacaccggaaaggataagaaaaaataaattttaattcctccaaacggttttatattaggcaattattttttacttctttaatttgcttacatcatacatagaaaaacaatcatagaactcatctgaaatacctactgtcaacggggcgcagtggctcatacctgtaatcccagcactttgggaggcagaggtgggaggatcacttgaggccaggggtttgagaccagcctggacaacatagtgagacctggtctctacaaaaaatacaaaaatttgccaggtgtggtggcttgcacctgtggtcccagctactcctgcttgggagctgaggtgggagaatcacttgagttcgaggctgcagtgagctatgatcccgccactgcacttctgcctgagtgacacagcaaaactctgtctctaaaatggaaaaagaaatatcactattggctgggcgcggtggctcaagcctgtaatcccagcactttgggaggctgaggtgggagaatcacctgagttcaggagttcaagaccagcctggccaacattgtgaaaccaagtttctaaatacaaaatttggctgggcatgggcctggcgcagtggctcacgcctgtaatcccagcactctgggaggccgaggcgtgtggatcatgaggtcaggagattgagaccatcctggctaacacagtgaaaccctgtctctaccaaaaatacaaaaaaaaattagccggacgtggttgtgggcgcctgtagtcccagctactcgggaggctgaggcaggagaaaggcgtgaacccgggaggcggagcttgcagcgagccaagatcgcgccactgcactccagcctgggagacaaagcaagactacgtctcaaaaaaaaaaaaaaatgagctgggcatggtggtgggcacctgtaatcccagctactggggaggctgaggcagaagaattgcttgaacctgggaggcagaggttgcagggagccaagattgtgccactgcactccaacctggatgatagagcgagactgtctcaaaaaaagaaagaaagaaagaaagatctactgctgtttatttttgtttccttctttctcttccttttattccctttttcttctttctttctcattgcccctccctctctcccctgttctccttctttctctgtaggatggacccgagagggcagacgctcctccgccgcatggtggcagaagggcagggccgagatgtctgggagactatgaagtctggtttagggtctttcaatgtggggctggttaggattagggtaagggtcacaacacagcaatttagaagtggcaaacacagcaaggtgagggttcagagagccctaggagtaaacttgtttctgctttctaccgaagagttgatgggcctttctggaagttgctggaatgaatgatgaagttgtctcctagaaagcaggactgttctgggaaggcagccccaaagctatggccactggtgcggatgctaagccgtgggctcggccttggcgccccccgtggtcagaggacaccgccagtgaggggacgatccatgcagttccccacagctgagtgccatccaggatgggtgtttcagcccccgtgcagttcccctgcttcccttgctggatgatcattttgggatcatttgcagggcagcacctgcacagcagcattttgactcaaacactgagccaggcgcggtggcttacgcctgtaatcccagaactttgggaggtcgaggcaggcagatcacttgaggtcaggagttcgagaccagcctggccaacatggtgaaagtccacctctactaaaatacaaacattagccaggcatggtgacgcacacctatactcccagctattcaggaggctgaggcacgagatgaaaatcacttgaacctgggaggtggaggttgcagtgagccgagattgagtcacagcactccagcctggatgacagagcgagactctctctcaaaaaaaaaaaaaaaaaaatcaaacactgggctgggcatggtgtctcacgcctataatcccagtgctttgggaggctgagctggaggccagaagttccagaccagcctgggcaacacagcaagaacctgtctcttcaaaaaacttatgcacaactctagctcactgcaacctcaaactcctggattcaagtgaccctcccacctcagcctcctgagtagcttggactacagggatgccaccaccccagctcatctgcagcatcccagtcatcaggtaggtctaaagcaaaagaaagcgatagggtcctgtaaggcctgtgagagtgaggctgcctgcacctgggctccaccagctccctgccaccttctaggctctagctcagtgacagcccagtgcaaagagcagctcctgccagagccccggcactgttaggaacatcaagacagaaaggcttccatttcagatgcctggcctgttgtggtttctgctccaaaaaaaatcacctaatggttgagtccagttgcccaggaacaagagattgcaatgaagcgaacctgggtgagttccaaagaaaactgaacaagggacaggcgctctggccagcatgcttccccgcgtctgccactttgagggtaaatcacacgcaggaccagccccagaccacgctgtcttggctatcccaggaccacagcgggcacagacctggcccttcactgacagcacccccaccccgacccacagcagtgcccctcacggagccttgaagctatggtagggggcattcagtgattcatgcaggtccgtaagtgagccccagaagaccatggggccctggcctgcctcccacaccctcgtccccagcccaggcctgaggctccccacagatgctgcccctttgggaatgggagcaaaatgggacccagaaagagtctgtctcaggccttccagagcaggatgggtctcctccaataggtgcctcttaacccaccaggggtcatggacccttggagagctgaacaaattggctgtctcagaaaatgcactttgtcacctacacacacaattctgaatacacctatcctgcacaccagcatgaacgcgatttcacaaaccaggctccatgggcctcaagtacggactggtcctcgaggtagacttgcttctgaggactgttaatgggcccctcagaccctagaggaggcagcgcagatcagacctggtgcctcccacgatcagactggcggccggcggcctggcaactggtggggaggaggtttttactcagccacgagctgctggccaggtccaatggggagacagtcaggggcttggacatggaatcagttcactgtcagacagcccaggtcccggtgatgaggatatctactcatcatgatgacaacactcagggcagctgggccacgtgctggacagcccagctttcagcaggggttaggccgatggtgcacaggacaggctcagcctggggaaaggatgtccctgccattttgctagcctggaagtgctctggaaggaggacagaaaacctgccttagccagggcatcccagggcattgagacaacaggaggacaggcgtgcgcacctccgggagcaggcgggaggggggctgaggaggggctgggggctctgggccagggaggcaggggatggcctggggctggaggtgtctcaggacagaagaagctgggcttcactggcagctgcactggccctgagtactcctcacctcctgccctgccgatcgtcagccaagcgttctggaaagaacagcgtgaaagcagagccagccagagaaagccaaggagagttcatggaaacagcaagaacggcatggtgtcggaaggcaggaccacctctgtgacctcgggggcagtgctgccctctgcgaggcagatagggatgagcctgcgtctgctgcccacccagcagcgcctgagctaaaccccctgcgccaccatgaacaaacatctggcatcaactcactcgctgcccccaccccccctcaatctgctttggtagagaagagcctgggttcaggctgagcactggctatgctgaccctccccgtcacctggggagaccggcggaggtggcagcatgaggaagtggaccccagagagcacaagtgacagaagtcccgggagccagagggtggggctggactttgactcacagcgcctgatttcagatgctgggttggccacacgctagctgtgcaatcttggacaagtgactccacgtccctgggcttcctctcactttttcaaaactggtggttgtaggcattgaatgagttaaagtaccaagtgctcagaactaggacaagcacaaggagttatccagggctggttctcctgacagagaatgtcctcgctgcagaggttgtgagagaacttcattaacctttggggatcccgcgtcctcacagctccatcctgaggccgcctgggatgctggtgctgcgcctttgtcaggccccagcaggagggccataatgaactacaagtcctcagacccggatccctttggtagaactgctaggatgaatgctgcccacactggagtgtgcagcagattgccctggagagtgttaaaataacataaaacaaaactattcttgaaaaaattacatttacactaaagtggtccatcccctggaggccaggggaggcccctcttcaggcccagattctattctaggaccataatatttccatgaaaaggagaaaaagtgctgcctcagagacccaccccccaccaggggaagcctgggcctgggaccccttcagtaggggtctgaagcccaggtcttcctggagatgcttttacactgtttggtctttgaaatatttccattttgagatgttcttctctgaaaactcctcctcattcagagcctgcctacagccggccctggagcatggaggtcacagtctgacttggtacagggacaccacctgggtttcggatgagtggacagttttctgtcatttttccctgcacttcttgtctcctcttcttgtttagatgattttttgcttattcctttctatttctgcagttcttgttttctcttttcttttttttttttttccaagatagggttttgctttgtcacccaggctggagtgcagtgaagcaatcagctcactgcagcctccacctccctggctcaagcgatcctcccacctcagcctcctgcgtagctgggaccacaggtgcacaccaccacacctgtctaatttgtttgtttgagttttttttggtagagatggggtctcaccatgttgcccaggtgggtctggaactgctgggctcaagcgattctccagcctcagcctcccaaagtgctgggattacaggcgtgagccaccgtgcctggcctggctaatccttttcttttctttcttcctttctgtggatcgaaggccttctctgccactcaccacagcactgtgcttcctgccttccctgccctgggagcctctgcaggccagagccccagcaagtgcagccttgtggctgtacacctgaactgccttccttccctgtggctggaacttcctcccagattgtcgctgtgcacctggcctggcttccagaggccttgggtgattccctgggtgaggcccattcctagccttgcaggttttcagaaggtaactttgctgctttggccagaaggccgcaatgtggcagtattcagcaacgtggcatttctgtgcagagttttaaactttggttcagttcgttgctgattcatttgatgtcttaaggagcatggagctccaagaataaaatggtaataagtgaggacttccagttctgattctgcacgtaaggagcttggaagatatctttcagtagatatctggcactaggttccctgcagcctactcccaaggaaatcatttccgagctgggcttttccaacctcgagtttggccaggccgcatcccctctccccagcagccctgccgcctccctgcactctcatgcatgcctctggtttgcagtgatggctgctccctccgccaatgtcacctgctgttcatgcagcacgtggccgcaccttctggtcagtgctctgactcacctgcctgtcagttattcttctgtgggccaggtcttcaggatgatcctttgctggttccttgtccctaagttatctccaaaggtgagtttttcccaaaccaggtttttgcaggacgtttgtgctggggggatcaagggctgtgttctaggcttgtgcaggctttgttacaatccagtttggtgtgtcatcattttcctcattttaaaggaataaatgaggctgggtgtagtggctcaagcctgtaatcccagcacttttggaggctgaggtgggaggatcgcttgggctcaagaagtcaaggctgcagagagttgggatggtaccactgcactccagcctggatgatagagtgagaccctgtctcaaagagaaaaaaaaacgaataaacaagatatcatgtgtgagagaggttataaaggtaaggtataaataataaatagaaagactccgcatagaaagcaggacatgccatgtcctcaggtggcctctgtgtgcttgagcctgagtcagcctctcaagggtgcgaccgctggccttggaggtgagcgcatcccctgacccaccccaggctccactcttgtccttggtgtgaattgtttccttgctgcttgttgtggttttattttgtgttgtgccctgaaagaacacaccagggggtttcatgtgccctccccttcctctgtgcctggtcttgtccctgcctcaccctcggccaaggggccagcctctgcagacctgcctttgtgatgtcatcttccctatgatcagacactaaactcaggaaggcaccaagactggcggcatggctttacacccaaaccatcttggtgcttcatgacagccagatccctcacctcactgcccgagatggcagccacatgagacaggccctggaaataacaggtaccgtgatgtccttgacctttaattagctccacattttctatttgctactcaccgaagagctgacctgctgacctgtttatgcagcccacagggcggaaaaagttctaaaatctaaaagtgaagctcagaggctaattttgtatatgcaaaatgtacaagatatgaataaagtgttatattaataaaatgccctagaactcgtactctttccagagggaatgggaaggcctggggccgcatccatgtcctggctgtgctgtgctgcgtgcccctggggaaatccctaccaaatcactctgggtcgaacctcatgaggggttacttctcctctcgactcttctgttgccagctagtgtcattatttaatcaggctgtcaggtcatctcgggatagatggtttctgcttttctgccatgcttgcctggagactcagtttaagctaaaagctagaaactgtatctccaacagaggactgtctcaaagccagggtggaaagagccggattggacactcagcaaatgacaccatgaggacatggctggtggtgcaggcatcttcgcaccagacaacgttacatgtgagactgcgcccaggagccgagtgaggtttctaggactctcaggagggagcagaaggaagcaactccccatgactccatggctggctggggcacaagctcacattcgggaagccacagaggggagcgtcttgtcactttgtgccttagcactgcggtgccctcagtgtggggtgagcaaaatcacaccttttctaggaataggcccttacactgactgacagactccacagataaacagtgatgtggcttcccccgctcatgggaagtgcatggtgaagaagagaatgcactgagtgagtaatgtccgagcgtgcctgctgccccagcctcctaccccacaggggagatgcctggggtccggctcgggacgcacggcagtccagcttccctagggacacccctgcctgctcgtcctctgcttcaggcctgatcatcatcgccaaggagaaacctcatgtttttaagaagtccctgtggtggtcagccaagggactgcttctttgctcacagcaaggcaggatgctgaggaggagtttgagagccaggctgaaaacagtgaggtggatgcaggagccagctgggatcctggccaagggggtggagagagagtcgcaagctggctgtggcttctctgcatttccaatttgcctttctatagaataatgataagagagcctccccactggtgggtcatgtattttcaatgagttaatatgtgcaaagggacgggcatggaggtcagaacttcaagaccagcctgaccaacatggtgaaaacccgtctctactaaaaatacaaaaattagctgggtgtggtggcacaagcctgtaatccctgctattcaggaggctgaggcaggagaatcacttgaacccgggagatggaggttgcagtaagccgagatcacgccactgcactccagcctgggcgacagagtgagactccgtctcaaacaaaaaaaaaaaattgcaaagagcatcaaacagtgcagcgtcatgagtgagctcatgctctggccccttattttcatttagtgccactggagaccttgaggaagggggtccctttgaaatttggtgaccaacatccatccatctcagctctgtcctggaggtcagctaagatcatgggtaagtgctttgccaagaccactcgctacaatgtgtctctggaacaacatccccttattgccgcagtgcagttccaagctcctgctggagccggtgcctgtctggacacctccccaccacccctactggagaacctaacattcctgcctccgtttttgcctgcagttcttcaacatagaatctctgctcccaggagcagggtggtttttgtttttgtttttgttttttttgcaggggggttgggtgcgtatcagttgtcaggcctctgagcccaagctaagccgtcatatcccctgtgacctgcacgtatacatccagatggcctgaagcaactgaagatccacaaaagaagtgaaaatagccttaactgatgacattccaccattgtaatttgtttctgccccaccctaactgatcaatgtactttgtaatctcccccacccttaagaaggttctttataatctcccccacccttaagaaggttctttgtaattctccccacccttgagaacgtacttttcgagatccaccccctgcccacaaaacattgcttctaactccactgcctatccccaaacttataagaactaatgataatcccaccaccctttgctgactcttttcagactcagcccgcctgcacacaggtgaaataaacagccttgttgctcacacaaagcctgtttggtggtctcttcacacggacacatgagacatcagtaattctatttcgaacatgctcaatttgaaatgggcattagatatctgatatggtttggatctgtgtcgccacccaaatctcctgttcaattgtaatccccagtgttggaggtggggcctggcgggaggtaatttgatcatgggggcggagttctcatgaatgggtcagcaccatcccctcggcactgttctcctcttagtgagtgagttcgggagggatccgactgtttgaaagtgtggggcatctccccattccctgtcttgctcctggtcctgccatgtgagacacctgctcccgctctgccttctgccatgagtgaaagctccctgaggcctccccagaagcagatgctgccatgcttcctgtacagcctgcagaactgtgagccaattaaacctcttttgtttataaattacccagtctcaggcctttcttcagcagtgtgagaacggactaatacagcatccaagcatgatgtgtgtgaggcagttggctgcttgagcctgtgtctataaaaacaagctggagacagtggcttggggagtcagcatgcagatgaaatttaaaaatcatggctcgataccttcatttaaggagggtgaagagatcaaaagaagggtccaaggctggatggaggctgcaccactgccaccacaaaggtgagaaagtgagacccagggaggccccctgagaaaggctgaagaccagggaatgctgtctcaagccaagtgaggaaaggccttcaaagagatggtgaggtccaccggaaggctgggcagggtatgggagggagatggctgacctggagattcggagagggtgcagtgactggtaatactgaggtctagagtctcatgggtgttcacagtgggacagaggtgttatcataaggatggcatattataaaggatgcttccaggttcaagtacaggaaatcctggccaaagtggcttaaacaacagggtgttggccaggcatggtggctcatgcctgtaatcccagcactttgggaggccaaggcgggcagatcagctgaggtcaggagttcaagaccagtctggccaacgcggcaaaaccccatctctactaaaaaatacaaaaattagctgggcttggtggcacgcacctgtaatcccagctacttaggaagctgaggcaggagaatgatttgaacccgggaggcaaaagttgcagtgagccgagatcgcaccattgcactccagcctggacgacagagcaaaactccgtatcaaaaaaaaaaagaaataaatgaagaaaaagaaagaaagagagagggagggagggaaggaaggaaaggaaggaaaggaaagaaaggaaaaaaaggaagaaagtcatggatgcctccgcagctccccacgtcatttaccaaggccacttgcccataccacagacagagagtccttggtttctggtcctgccagtcagaattgggcggaactgccaagttggcccaaccctactccaatccctgacaaagggagcggccttcaggaggctcggctctctgtgcactttgctcaagatacctgaagaatgattactttgaggaagaaaggaagacttttaggaaagaagcgactttgttttcgcggtcaaggagcgaaggccccaagagaccaaggtagacgctgaaggaatccgggaagatgacagaagcggtgaagagacgcgaggtggggccaaaatcttcactaaccaacaaggagggctgcgggggctttggagggcctcttttctcgcaaccgtggcccctccgcccctcacctgccccttgagtgtctgtgcaggggtctcacacgcgagcttggctactcagaccaagccggtttaccgtcaccatggcaacagcgcgtcctgggctggggcggggccagactgccagtgcctttgtggcgcattaggagctaagccagtgattggccatctgggcgcggggcgggctgagtcagttggagggggcggggctgaggctccggtgaacgccgtaggcccgggctgggccgagggagatgatggatgccgcttcttgccactccccgggggcaccacagagagcggggagcctgcagagagcagggacagcggcttcaaacgcactgtttccgggcaatgtcactaataccaaagtcatgcctcccactggacactcctgggctcccatccttcctaccaagaaactttctctgtgaaacccacgaaacagctagaaatggagcccaaaagatagccaggataacagaccacagagaggatcaaggcccagcaggacctggcgactctaacgctctggcactagggtgtctagaatgggaagcccccaaggggctggagtgggatgggggtgtgatgcaggccgcccaccaggttccctccgggcaaagcggcagggccccgcgcttcctgagccttcacggaggtctagtggtccctctgcctgaaaacctgtctgtttgtcaggaggagttcggagcatataattttggggagccattttcttctagggagttcactttcctgtgcggggcggcggaggaagacaacacataactgaacgacagatgaagataaattataaaagaacattgtttaagtgtttaatcagacaatgaagagaaacccaaaacaatgaaaccttttcaaggaagtaaggtacacaataaaaaatctcttggaggaagtatcaaagcttaaagatgagtggaaaatcggcttgctttttggggaccaaaagaaaacagattttttgtttgtttgttttttgagacggagtctcgctctgtcgcccaggctggagtgcagtggcgcaatctcggctcactgcaagctccgtttcccgggttcaagccattgtcctgcctcagccgcccgagtagctggaactacaggcgctcgccaccacgcccggctaattttttgtatttttagtagagacggggtttcacatgttagccaggatggtcttgatctcctgacctcgtgatccacccgcctcggccttccaaagtgctgggattgcaggtgtgagccaccgcacccggacttttttttcttaacacagagtcttgctctatcgcccaggctggagtgtagtggctcgattctggctcactgcaacctccagttcccaggttcaagtaattctagtgcctcagcctcccaagtagatgagattacaggcatgtgccaccgcgcccagctaatttttgtatttttagtagagacgaagtttctccatgttgaccaagttggtcttgaactcctggcctcaagtgatccatctgcctcagcctcccaaagtgatgggattacaggtgtgaaccactgctcccagccgaatttttaaaatatacttgaaagctggttatctatgagctgatggcaagtttttttttttttttttaaagacagagtgtcactctgtcgcccaggatggagtgcagtggtacaatcatagctcactgcagtctcaacctcccaggcttaagcaatccttccacctcagcctcctgagtagctgggaccacaggcgcacaccaccacacctggctaattttattttttatttttatttttgtagagatgggggtctcattatgttgcccaggctggtctggagctcctgggttcaagcgatcctcccaccttggcctcccaaagtgctgggattacaggtatgagccaccatgcttggccccagttgcaagattttattaaaaattttataggtcaaaaatgtagaggttaaaagaccctcctgaggaagctaaacaaagtgcagacaggtacaaagctgaactccatcggctcaaagaaaacagtgcccggcagaagatgccagagcagttacattcaggaagctccatgccagtgggagcagccccctgagtgagaactccctggactatctgttctagaagccctgccttacagagtggatgatgtgaaattgtgagcagtttcagctgtaggcagcaaaaacttggcccaacaacagaaagagaagataaaacatcagaggagagagaggacagatgtcacccagacaaattctttcttaacaagggttgaaaaaggaggcggctagttcccatgcagtgtgagccatgggtggtgggcaagatcacaacacactgcacaaggcagaggcaagatgtgagaatgaatgcaagtccttgccgggagtccccatgaccccatcagccacaggccggggcactgcaacagaggcagactgcacatggacgtgtggtgtctgcatgggctgcatggaccctcacatgcccactccacagctccatcacaggcctctgcaaagacctcctgttgccccgccttctcttattagtttcctgggctgctgtaacaaattacaacgaacttagtgacttaaaagaacagcctagttttttctcacaggtcctggagtccagaactctgaagttaaggtgtcagcaaagctgcacttcctccagagcctctagggtagaacccatgccttgcctatggtggctgcgggtgttcctggacttgtggctgtacaccccaatgtctgctcccaccatcacgtggccttccaactgtgtgtgtctaatctcgcactacctctctctcacaaggacacttatgatggcattcagggcccacccagataacccaggatgaccctcacctgaggatgcttaaatgaatcacacgtacaaagaccctttttccaagtaaggtcacattcacagatttcaggaagagaacatggacacacattgctggggtggcatttttcagcccaccacacctcccagtctttctccttctagacccctgatcaccagcccagccatcagccactgtccatcagtttcatgtttactctaacctcagtccgcttctttccacatagtgaatgacggttgctctgtcagaatttctgcctattgggaggactttcccccaccactgtttttcagggctgtcccatggcaggctatagcacagcagcatttggggcttacatccacctatcaagccatgacccaagtttggcccctttactcccacctctaccccaattctgagctgagtgagacaggggcccgatgcaacctttgcagacaatatggggcctgggccacctgcttgtgcagctcctggctgccacatggccctgctctggcccagaatggaatgcaccatcaccatcatactgtgaatggggctgttgggcccaccactgattttataacttgggttctagccgaacccagctcaggatgggcagttctggctgcagagtcgcttgatgtctgttgctgggtgctctgcctccatcagggcccggtggcatgctgggagctgttctggttgggtttggttttttgggtggtatatgtataattatcagttacagatggtgtggtcttgatccagaaccctaattgtctgtattgtgattctcccatgggaacctgtcgtaaactccaaatgccctctttttctaccatagatacctcgtatacattaaggtctgctggatcttatgatggaaggagcagggctgctgacccacatcctgaacttgctacagagccctttccagctctgggcccagagccttcatatagctcaataagggggccagagcagcatgcccacctatggggtttgctacctttaaacccaagggagcctactaagcatcgtgctttattctcgttggtgggaagtatgagatgcaatcatttgtcttttactttggaaggaatgtccaagcatgtcccaaaccactggatccctgaagtctccacaaatgtgtttagcaggctggaagatacaaggtcaatatatatatcaattaattaggtatacaaaaataaagtgcattcagaggccaagcaaggaggatttcttgagaccaagcgttcgagaccagcttgggcaacatagtgagatcccatctctacaaaaagttttaaaattagccatgtgtggtggctcctctcacctcaacctcctgagaaacctgtagttctagctacttgagaggttgaggcagaaaaatcccttgagcccaggagttgaaggttacagtgagctatgatcataccactgcactccaacctgggtgacagagaaagaccctatctcttaaaaaaaaattaaattaactcaaaatggatcatacacctaaacatagtttttgtgttagctaaaactataagccttatagttttacccatgctatcatgggttatatattaacccatgctatcatgggttaatctcagctgatctggattaaccacattgtgacggttaattttaggtgttgacatgactggattaagaaatacctacaaaactggcaaaacagtacttctggatgtgtctgtgagggtgtttcaaggagactgatgtgtgagttgctgcactgagtcgggaagatgttcctcaatgtgggcagccaccattcaattggctgggtgtccagagagaacaaaaaaggaaggaaaaggattttccctctctctcctggaactgggacactctcctcttcctgccccccggttctcacgacttcagcctcagacagagacttacataattggtttccctggttctaaggtctctggacttggactgggccatgctaccagcatctcagagttgccagcttgtagacagcctgttgtgcgacttctcaacctctgtaatcaagtgagctaattcccctaacaaaccccctctcatatgtctatatctatcgatagctcctattgatctgcctctctgtagaaccctgaccaatgcacacatgcttattacaaggtattgacccttggccaatgctgtgcaatggattaactaaagataaagatgttctataactatgagtctgtgagttgcttcagggcaggactaccagcctgtcagcattgttcaataataattgaactcattatttgtacctggttttagaggggtctggaaaattttgaaagctaaagctggtcacaaagtcggaacatacctatgtgatcagctcactctaagactcccaccatgagccgacttcaggcttcttgggaccgaggtgcttccacacacagtgttcaagggcaagatctgaaatcaaagtgcatcctatgtgtcccagtgttaaaaatatctagatctcaaagtccctttagtgcatagccttctgcttttgctactgtgcctataaaaaagcacaagtataaaccgagtcctgcacgtcctttcagcagctgaactcttagggtgattaatgtgtaattcacacaaattccttaaagaaggcataggagaacatcttaacaacctttggtttggcaaagattacttagataagacacaaacagcataatccatgaaggcaacaaatcaataaattgaactttctcaaaattaaaactttggctctacaaaagactgttagaaagaaaaagggagctatatactgtgaaaaatatttgcgaaatatatatccaacaaaaaacatgaatctggaatacataaagaactcccataactcaataataagaagacaaacaacccaatttttaaaaatccaattcatatgtgagcaaaagacataaatatatatttcaccaaaaagggtatacattcgcaaataagcttattaaatgatgctcaacatgattagctattagagaaactcaaataaacccacaatcactatacacctatcacagtgactaaaataaagaacagtggcctctccctctccctctccctctggtctccctctgttgctgaggctggactatactgccgtggtctcagctagctgcagcctccctgccccgggctcccgtggttctcctgcctcggcctgccgagtgcctgggattgtgggcgagcgccgccgcgcctgactggtttttgtatttttggaggagacagggtttcccctgttgaccgggctggtctccggctcctgacctcaagtagtctgcctgcctcggcctcccagggtgctgggattgcagacggagtctcgctcactcaatgctcagtgttgcccaggctggagtgcagtggtgtgatctcggttcgctgcaacctccaccttccagctgcctgccttggcctcccaaagtgctacgattactgcctctgcctggccgccaccccatctgggaagtggggagcgtctctgcctggctgcccatcgtctgggatgtggggagcccctctgcccggccgccccgtttgggaagtgaggagtgcctctgcctggccgccaccccgtctgggaagtgaggagcgtctctgcctggccgcccatcgtttgggatgtgaggagcgcctctgcccgccggcctcctctgggatgtgaggagcgcctatgcccggccaccccgtctgtgaagtgaggagcacctctgcccggctgccccgtctgggaagtgaggagcgcctctgcccggctgccaccccgtctgtgaggtgaggagtgtctctgccaggccaccaccctgtctgggatgtgaggagcccctctgcccggctgccccgtctgggaagcgaggagtgcctctacctgaccgccctgtctgggaagtgaggagcacctatgcccggccgccccatctgggaagcgaggagcacctctgcctgaccgcccatcatctgggaagtgaggatcgcctctgcccggccgccccgtctgggaggtgaggggcatctctgcccggccaccccatctggaaggtgaggagcgcctctgcctggccgccccgcctgggaagtgaggagcgcctctgcccggccgcccttcgtctgggaggtggggagcacctctgcccggctgccccatctgggaagtgggtgcctctgcctggccgccccatctgggaggtgaggggcgtctatgcccggccaccccatctgggaggtgaggagcacctctgcccggccgccccgtctgggaggtggggagcgcctctgcccagccgcccatcgtctgggaggtggggagcacctctgccaggccaccccatctgggaagtgtacccaacagctcggaagagacagcaaccatcgagaacgggccatgatgatgatggtggttttgtcgtaaagaaaagggggaaatgtggggaaaagaaagagagatcagattgttactgtgtctgtgtagaaagaagtagacataggagactccattttgttctgtactaagaaaaattcttctgccttgggatgctgttaatttataaccttacccccaaccccgtgctctctgaaacatgtgctatgtcaactcagggttaaatggattaagggtggtgcaagatgtgctttgttaaacagatgcttgaaggcagcatgctcgttaagagtcatcaccactccctaatctcaagtacccagggacacaaacacggccgaaggccgcagggacctctgcctaggaaaaccagagacctttgttctcgtgtttatctgctgaccttctctccactattatcctatgaccctgccacatccccctctctgagaaacacccaagaatgatcaataaatactaaaaaaaaaaaaaaaaaaaaaaaaagagaacagtggcttggtgtagtgtcccacacctgcagtttcagcactttggaaggctgagggggaaagactgcctgagcccaggagttcaagactagcctgggcaacatagtgagacccaatctctacaaaaaataattagctgggcatgatggctcacacctgtagtcccagctatttgggagactgaggtgggaggatcgcttgagcccaggagatcgaggctgcattgagccgagattatgccactgcactccagcctgggtgacacagcaaaaccctgcctcaaaaaaaaaaaaaaagaaagaaaaaaaaatagtgataacaccaaatgatagtgaggatgcagaaaaactagaccacacattactgttaggaatgtggccaggcacggtggctcatgcctgtaatcccagcattttgggagacagaggcaggtggattacttgaggtcaggagtttgagaccagcctggccaacatgatgaaaccctatctctactaaaaatatttaaaaattagccaggagtggtggcgggcacctgtaatcccagctactcaggagtctgaggcaggagaatggcttgaacctgggaggtggtggttgcagtgagccaagatcaggccactgcactccatcctgggcaacagagcaagactccatctcacaaaaaaaataatgtaaaatggtacaggcaccctggaaaatagcttggtagtttctttctttttttctttctttttttttttttttaagatggagttttgctcttgttgcccaggctggagtgcaatggtgagatctcggctcactgcaacctccgcctcctgggttcaagcaattctcctgcctcagcctcctgagtagctgggattacaggtgcgcaccatcatgcctggctaattttttgtatttttagtagaaacggggttttaccatgttagccaggctggtcttgaactcctgaactcaggtgatcctcccgcttcagcctcccaaagtgctgggattacaggtgtgagccaccatgcccagccggtagtctcttataaaactaaatatatactggccataaaacccagaaaccacactcacatttatcacagagaaatgaaaactgttcacaccaacacctggccacaaatgtccacagcagcattattcacaattgccaaaaactggaaaaaacacaaatgctcttcaatgggtgaatggttaaagaaactttgatacccccataccatgtaatactactcagcaataaaaaggaaccgacaattgatatattcaacaacttggatggatctcaagcaaattacgctcagtgaaaaagagccagttcaaaaggccatatactgtgtgattccatttatataacatttttgaaatgacaaaatagacagatgaaaatcagattagcagttgccagggtttaggggcagaggaggagggggcggacataggtaaagggttagcatgaaggacttctgtggtgataattattctgtatcttgattgtggtgctggttacacgaacctacacatgtgataaaattgcattgaactattcacacgcatacatacaacacacacaagtgagtgcatgtgacactgatgaagtacaaacaagctctgaggactgtatcaacatcagcgtcctggctttgatattaaaccatagttagagaagatgttatcattgggggaaactgggtgaaacgtacacgaaacttcctcgaacttttttttttttttgcaacttcctgtgggtttataatcatttcgaaatttatcctctttttttttttgagacagagtctcactctgtcacccaggttggagtgcaatagcctgatctcggcttactgcaacctctccctcccaggttcaagcaattcttctgtctcagcatcccatgtagctgggattacaggcacgcaccaccacacccggctaatttttgtatttttagtagagatggggtttcaacatgttggccaggccggtcttgaactcctgacctcaagtgatccgccagccttggcctaccaaagtgctgggattacaggcatgagccactgcacctggcccaaattttaaaattcttaacatatattatttttaaaatgcttctccacccactcctctccaccgctgtacttctgttgctatctcaggcagtggtccatgaaggccagcaccacaaataaagctacaactgctcagtgtttatgtaacacccagataaaaccacccccacccttctccatgtcatctcaatgtagtgacatagccaaaagtaacgcaggtccaaaaccctgagcagtcatggagagctttgcttcaagttttcttgggaggactgtggagagtaggctcccatctcatgatgcaaagcaaaacttcctgatgtcgtccttcccacccccgaccaaagctgcgctttaaagcagatcctccagtatctcctcccctctccccatctgcttctctccccctaagcttccagccttctcttcctctcccctcccatcccctccaacaggactgctggatttccggcaaaaactcccaggtctgttctaacatggatcagcctgggctcttcccatctctgcccactcccacagcaaaggccccataaggagcagccaaacactcgcacctcctcatgacacaaaggaaagggaaggctgtgaacagccacttgcgctgtagcatttttgtttctgttttttttttaaaaaaaaatgggtaggccgggcacggtggctcacgcctgtaatcccagcactttgggatgccaaggcaggcagatcacaaggtcaggagttcgagaccagcctgaccaacatggtgaaaccccatctctactaaaaatacaaaaattaaccgggtgtggtggcacgcaactgtgatcccagctacttgggaagctgaggcaggagaattgcttgaacccgggaggcagaggttgcagtgagctgagattgcgacgatgcactccagcctgggtgacaaagcaagactctgtctcaaaaataaataaataaataaataaaatggataaaagatttggagaatcacctcagcaaagaagataagctgatggcaaataagcacaggaaaagatgctcaacatcattagtcattagggaaacactcattgaaaccatgaagagacaccgcgacacacccactaggatggctacaaccaaagagactcaccatggcaagtggtagtgagggtgtgaagaaactgggacattcatgcactgctggtgggaatgtgaaatggcacaaccatttcggaagacagtttggcaggttcttatgaagttaagcatacagccagggatggtggctcacacctaatactttgggctttgggaggtggaggagggtggatggcttgagcccagcccaggagttagagactagcctgggtaacatggcgagaccctgttttgccatgtcacccaggctctgtcaaccaggctggagtgcagtggcacaatctccactcactgcaacttccacctcccaggttcaagcgattctcctgtctcagcctcccaagtaactaggattacaggtacgtgccaccacaatgtgctaatttttgtattttagtagagatggggtttcaccatgttggcaggctagtcttgaactcttgacctcaggtgatccacccacctcagcctcccaaagtgctgggattacaggcgtgagccacgcgcctggcctgcaagaccctgtttccaaaaataaaaaagttaaacctgccatatgactcagtcacttcactcgtagggatttacccaggtttcatgaaaacatagtccacacaagacctgcacagtaatatgtatagacactttattggtaatagttagaaactggaaacaacccaagtgtccatcaacagaagaatgcagccaggcacagtggctcatccctgtagtcccagcactttgggaggctgaggtgggcggatcatgaggtcaggagttcaagaccagtctggccaacatggtgaaactccacctctactaaaaatacaaaaattagcggcacatggtggcatgtgcctgtaatcccagctactcgggaggctgaggcaggagtatcgattaaacccgggaggcggaggttgcagtgagctgagatagagccactgggcaacagagcaagactccatctcgggggcaaaaaaaaaaaaaaaagaagaatgcataaattatggcacatccatgctatggaatactgtttagcaattttaaaagaatgaactgcactccaacctgggtgacagagcaagaccctgtctaaaaaagaaaaaaagaaaaaataataataaactattgatattcacatcactacagataaatctcaaaataattatgctaatggaaagaagccagacaaaagagtacacattgtatgattccatctatataaaattctagaaatcgcaaatgaatcaaacagaaagcagatcagtgcttgcctgtggcattgccttgcctctccaaggggtccttgggggagggagaaaaggatcacagaagggcataaggaaagttttcagtgatggatgtagtcatttttttgattgtggtgattatttcaccgggtatatatatatatatattcttccaattttggccgagtgcggtggctgtcacctataatcccagcactttggtagcctgaggcaagaggactccttgagcccaggaattcaagaccaggcgtggtgtagccgggcgtggtggtgcacacctgtagtcccagctactcaggaggctgaggtgggagcatttcttgcgcccaggaggtggaggttgcagtacgctacgatcatgccactgcactctagcgtgggtgacagagctcacttgaatctgggaggcagagtttgtggtgagccaagattgtgccattgcactccagcctgggcaacaagtatgaaactccgtctaaaaaaaaaagaaaagaaaaaaaagaaatcaatgtggctgctctcaaaacaccagatacgtctattgaatcatgcatagaacctgggaaagggacctctgggtggattcctgaatgcagtggacctacagtgagttgggcctgggtcaaaactctattgcctaactctcatatagccccaacactaccaggggaccacaataaggctttgggtccctgggtatcaatgccaagatggattctgtgtctagcagcacttgaaatgtttaaattcctctttacctagtatgtggcaactctagtaaatagccataagtgccactggggaagaactgaggaatcatgaccactcactcactgccgtgaaggagttgttcctcctggaaacccagcctctccttcaggcactggggtctggtctgaagtttttcactggggtagctgccctcagcctccatctcccatcttggatttcttttggttgtgtagattaagcaatgactttgtgggctgttctcctccttggccacaggaataacctgctcaattcgccacctccacagctctgggaaggtcggatgtccctggctgccacagcaatgttggcacctctgcttagagagggccatgctttctccaagcctccaggggctacacaggcagcatgttggccccacctcctgggctctttctaggatgttatatcctgtatcttagaagagtgttctcacagcagcctgggcaacatagtgagacccccatctctacaaaaaatagaaaaagttagcccgtgatgctggcacatgcctgtagccccagcaactcaggaggctgaggtggaaggactgctttgaagtcaaggctgcagtgagccatgatcgcaccactgcactccagcctgggcaacagagcaagaccctgtctcaaataaataagtaaataaataaataaaaataaactctactttatccaactttatgttctaccccctccctaccttgtcccaggaccctcaggcctgccacacacacgtgcacacgcacaactctctctgactcgctcttcctagtcaccttggccaagtcctgcagcttctttagaatttggtccctgccctttcttactaagcccaatgcctccccagccaagtgtagtctcaagttcgggtgtgaccaggagcaggtggctggccctgagggtggccattgccttgcaagtcagtggcggctgggcacctgggtgcttcccttcagacgaacccattccaagcttcagggagcctctgtccccacagagggagctaaactgaccaggactgagagttcataattttctctaattatgccctgggctcaattctcagcatttttagccctccagtagcaggaaatagtctctttagctgcagcctcaaggccccgtgaccaacactgtgctatggtgtgattggtggtgaatcatgcttagcctttcactgtctttctctaaccgatggtctcagcagcacccatccaactccaggccttattgacgtccatccccaggacctctcagaaaactgagctatggcatgtggggaaaagcaagagagatcagattgttactgtgtctgtgtagaaagaagtagacataggagattccattttgttctgtgccaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgactgtcccccagcccgacacccgtaaagggtctgtgctgaggaggattagtaaaagaggaaggaatgcctcttgcagttgagacaagaggaaggcagctgtctcctgcctgtccccgggcaatggaatgtctcggtataaaacccgattgtaatgctccatctactgagatagggaaaaaccgccttagggctggaggtgggacctgcgggcagcaatactgcttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacgaatgatcaataaatactaagggaacgcagaggctggcgggatcctccatatgctgaacgctggttccccgggtccccttatttctttctctatactttgtctctgtgtctttttctttcctaagtctctcgttccaccttacgagaaacacccaaaggtgtggaggggcaacccacccctacatggcgtccccagtgcacattctcccattctaattcaccaactgtggaggttctaagttctaacaatttcgcctgcttcagcatgccaggggcgtcaacctgccacccaccaccagggttagcgccagcagtgatgtgaagcagctcgcacatcccacgtggagcctgcttcctccacctgccctggaaccaagcccctaggtcaggttctctggaaaactcgaactggtcctgtgcaggcaggagccacccccatggtagagtgaaggagacaggatgccacaacggaggcctcgcccgatccctgggggagctctggtgctgggatggctggtcagggacatcctgccttgaggcaagggaactctgcccttccaggctactggaggtgccaagataccaaaaggaggggcatgaccatgggccgcgggtaattcctgcaggggactcagctgagagccaccagtagccactcttcccagtggctgtgggaccgagtgcctcagtcctgagaggatcttgcccatgggcacagagtgccagagaccttggaaagtccctctgagcacgactcctctgtgcctaaccctgagcagctccagggctccaccctaaactgtgtattgctttggacgtgccagcagttccaaatcctggggggccagccgggcagacagcatctggtgtggagagaacaaagagtgaagctgactgagcacacggtggatttgaactgttgcatgggcgggaggtggggtggatgagacagggaggggtcagggggatgctatggctggagctgaggtgctggacattatgaggggaagaggaggccatgggggaggttttctggtggggaccagacatggctagagcagtgcttgagaaaattccatccaacagaatggatgttaagaggggataattctgcattccctgagctttggctgtaccagtgggggcaaaaaaccactccaacctccaggagtgtcaggagagcgacacaggcacacaagaggcagaaaggcctgtacgaggccaagtgctagctagctgaggtccgaggcagggccacgtggaggggacctgcagggcttcctggctagtgtgtccagggggccctgcccgagggctgtccagtggggaggcgttggcctcatctccaactgtcaggaagggaatgtgactctccaggaggaggagactggcccaaagccacgcagccatgcagcggtggggtcaggacctgcacctgagtcggcactagaaccacctccttaaccaccagtccacactgcccacattgaggtggtcaggaggtcaggaacgaggagcaccaaggagcagccttgacaaaacggcccacagagatgccagggctaggaaccacactgctgcaagaggacagaaggggagatgcacgctgggaacagacactcaggacggaaatgtgtcaagaaggaaagaagaatgcacacggcagcctgaggggctggcagtgtccgacggggcttgttacagaagtggggagagagtccacgccagaggggctggtggggcaggggaggacaatgggcttcagaggggccgtgtgtgtatggaggagagtcataaagacaggaagaaagccaaggggaggagccccacggagaaataagacgggaaattcattcagggtggggtaggagagggtcagggagagagggaggactcctttctgctttggggtagaaacgattagagtggttttgttgttgttgttgttgtagtttttttgagacagagtcttgctctgtcgctcaggctggagtgcagtggcatgatctcgtctcactgcaacctccacctcccaggttcaagtgattctcctgcctcagcctcctgagtagctgggatttacaggcatccaccaccatgcccagctaattttttgtttttttagtagagacagggtttcaccatgttgcccagcctggtctcaaactcctgagctcaggcaacctgcctgcctctgtcccaaaaagtactaggattacaggcgtaagccaccacgcccagcctacgattagagtttttttaagtgctggggtaggaggcagtagacaggagccccggccatgggagaggctggcctggggcattgtgtggggcagtgaaaatgctacgggtagaattaggcgggaaggaagaggagtgtggcagaattccattctaaaacaggatagttagggaaggtttcacaggcaatattagaggaagatgtgaaggtgctgagctatcaagggtgggaaccagtgttaacactctacaggcaggagaggtctggtgctcttggtgcctggtgctatggctggaaaagcaagtgtagctggaacagagtggacaagggcgagaggaagaggaagtgaaggcagagaggggacaacaaacttcacacagggtcgtgggaaatactgtgcagactccgggttggattctgaggcaagttggtgccctcagaaggtttgcagctgaggagggacacgggtggggatgactgagctgctgttgacttggctgacaagtgaatgaggagagcaagtgcgcatgcagggagtccggccaggaggctacggcaggaaccagtgggaatgcaggaagcacggactgtgactcatatttctggaagtacctgcagccttgacaagaagtatttgcttgtgggtggtgtgctgggtgtgagagatgaggcgttcgcaagaatcctggctaggtgaatgggatgactggtttgaaggagatcagtggctgtacgttcagctcaaggtgtctaggagatgtccaggtggagatgttgggggaacaaatgcattagagcctggggttgaggagaaaggcccaggatatgaggagcatttgggaactgtgtgccttcaggaagaagggatgaggtcaccaatggcagtggatgttttagagaaaagttccaaccctgacaatcccggggggcatttcaacattaaaagattgggacagtgatgaggaactagtgaggagaccaagggctggtcagcgaggtaagagaaccatgggacagaggtgctggaggccaataaaaaaatatttcaggccaacggcagtggctcatgcctgtaattccagcactttgggaggccaaggtgggcgaatcacttgaggtcaggagttccagaccagcctggccaacatggtgaaaccctgtctctactaaaaatacaaaaaatcagctgggtgtggtggcacacgcctataatcccagctactcaggaggttgaggcaggagaatcacttgaacccgggaggcggaggttgcaatgagccgagattacaccactgcaccccagcctgcatgacagagcaagactccatctcaaaaaacaaacaatttcagaaagaaatgatcaaccatgatatggtcgggtggaaaaggcaggtggagttggagggaaaggagggagagtgacttagggtgggaggagagaaagtggaaacaatgaaggtggacaactcagcgtgactttgctgttaaggggcacaaagcactgaggtggtcgttgcaaatggaagtggggtcaagagagggttttaggagagaaccgtgctgtatggagggaaagaaggttggcattccccttgacagggatggaagaggccctcaggcctgacaacacacacagggttaaggtgctcccacctacttctggcgtctaaccctcattttttaaatttttttttttttttatatgaggagcatttgggaaccgtgtgccttcaggaagaagggatgaggtcaccaatgggagtggatgttttagagacaatttccaaccctgacaatcccagtgcagtggcccgatctcagctcactgcaacctccgcctcccaggttcaagcgattctcctgcctcggcctcctgagtagctgggattgcaggcgtccgccaccaagtagggctaatttttgtatttttagtagagacaaggtttcaccattttggccaggccaatctcgaactcctgacctcaagtgatccgtccgccttggtctcccaaagtgctgggattacaggcgtgagccatggcgcccagcctttaaatcttttaaaaactaaaaattaaaaaagagaaagagaaaaaatcagcatgtttccccgcggggggcaccgtctccgtacccccgggagacgcgcaggaaggacatcctggagtgaggagactggggagacctgaaggagtggagggcagggagggagggaggctgcgcggacggtggcgcgagcagctcaccgcgtggtgcacaggacgccgggctgggccggagccagaggcaggaaggtgggcagaggctgcagcgggcgagtaggagcgctcctgatggctgctctcaggagaaaccaaggccgagtgtgcagagtcgggcaggaaaacgccttgagagagtggctgacgcaagccagcagagggtgtcagggacagcgtgtgcgggctgccatgcgctcgggtgctgcgcagggtggagtcctggggcttggcccatggagtggtgtcgcgcccagggttaagggggtgcaggcggtgagagcaacggagcccaggctggtccggccctgccaggctaagctcgggggctccccccctgtccccccagtgcctgctgcgctgggcccaggccgcccgtgccctgccaggccctccggccccccaccctccaccccagggcctgctcctcaccccagggttccatctccctagtttccaccagagactgggtacgtgggggcgctggcaaggcgaaggaggaggcctgtttatcgtcaccatggagacggtggcggggtgggtcaccaggcttggtgggcccggggcgaggccggggagaggctgctttgcccccagccctcccttctcctacccccaccccttgtcctgggcccgccaggcccgtgagcccgcttcaggaggagcgcatacccggctccgacctgcagaaccgccaggggatagagtgcggtctgtgataattaacacagaaaattaacacatcttattctagtttatttctgtgctcatgtaaatagtgaatgatttagaatcctaccacagtgtgacagtgtccgctttcacaccctcggctggttctgacgcactcccggcgtaggaagttctggtgggtgccagatggttctgagttaaccttttccagttggtggcactttgtccccgatctcatttcaccctcaggacagtgctgtggaggggtcgctaagagtccgaatcagcaggtgggcactggtaataataccagtaataagaaccaacacaggacagcaggtctgtccagctccaccctctgctacttttttttttttttttttttttttgagacacggtctggctctgtccccgaggctggagtgcagtagtgggatctcagttcactgcaacctccacctcccaggctcaagcgatccttccgcctcagccttctaagtagctgggaccacaggcaggcaccgctgtctaactaatttttgtattctttctagagatagggttccgagatattgcccagtcttaaaccccggactcaagcaatgcgcccctctcggcctccaaagtactgggattacaggcgtgagccaccaaatccggcctattatgtcatttttacagttgccattttcccccaaatgtatagaaaacaatgtgcctcatatttcacaaatgttggtatcttcccagcaccgtgagcagggcactgttcacagtgggtcaggctgagttggtccccgcagcactgattctgttgaccctaatggcagcaagcagagggcagtttattggtgtctggccctctgtgtccctaatagaagcccctgcaagctgcacccttccattccaaggctctgggcctctggaggtggagttctctcagctggccccgggagacagcgcagtggccagagctctggctcatcaggtcagggaaagaaaatcaccctcagaatctctcatctctggccagcgttcttcctggtgactgagtcacaactgtcctgttgtccatgggtgtggtcatggcatagtgcctatgggtggtttttcctctggagtctccccaggactcttgtgacccagaagtgcacatcacacgcgtgctgtgcacaggcccctcgtcctcagtggcaccctgagatcaggcaatgggcaggcgtttataaatgtgcagctgctccaacccggcaccagaatggctgtggtgtgtgtgaggcactgctccttccaagagctttcagatttggggtgaggtgtacagaggaagcagccacctgtcacagaagacagagtagtaaagttaagagaaaagtgtgtccaggcacagtggctcatgcctataatcccagcactttgggaggctaaggcaggaaaatcacctgaagccaggaattcaagaccagcctgggcaccatagtgagaccctgtcactgcaaaaaaaaattttttttaccttagccaggcatggtggtgcatgcctattgtgcagcaactgggcaggctgaagcagaaggatctcttgagcccaggagttttaggctccagtgagctgtgatcacaccactgcactccagcctgggtgacagaacaaagaccctgtctcaaaaaaaattacagaaaggtatagacaaacagctgaggagtgtgagatcccagcagtcaggaggctttcctgagaagggaaaattggccctgggctctggagaagacatggaacttctgatgtgggatggtgaagggtatgggcactgccaaaatcccccctggactcccccagcatcccctctgtccctgcctcctcgctcctcctgctttgaagctgagctggcatttgcttctctgtctcatcactctcttttctttattcaagaaaagctggccgggcacggtggctcatgcctgtaatcccagcactttgggaggccgaggcgggcggatcacaaggtcaggagatcgagaccatcctggccaacatggtgaaaccctgtctctaataaaattacaaaaaaattagccaggcatgtggcaggcacctgtagtcccagctattcaggaggctgaggcaggagaatggcgtgaacccgggaggcggagcttgcaatgagccgagatcgtgccactgcactccagcctgggtgacagtctcaaaaaaaaaaaaaagaaaaaaagagtgttggccaggcgtggtggctcacgcctgtaatcccagcattttgggaggctgaggcaggcagatcacctgaggtcaggagttcgagaccaacctagccaacatagtgaaaccttgtctctactaaaaatacaaaaattagccgggcatggtggtgggtgtctgtagtcccagctactcagggggctgaggcaggagaatcacttgaacccaggaagcagaggttatagtgagtggagatcacgccattgcactccagcttgggtgataagagtaaaactgcatctcaaaaaaaaaaaaaagaggagtcttaggagtaaatttaacaaaataattgcaaaatgtgtactcttaaaaatacaaaacattgttgaaagaaattaaagtgctaaataaataaataaggttgggtgtggtggctcacacctatggttccatctactcaagaggctgaggtgggaggatcacttgagcctgggaggttgaagctgcagtaagccatgatcacactactgcactccagcctgagtgacagaatgagaccttgtctcaaaataaaaaagttaaatgccgggcacagtggctcactcctgtaatcctagcactttgggaagtcgtaggcaggcagatcacctgagatcaggagtttgagaccagactggctaacatggtgaaaccccatctctactgaaaatacaaaaattagccaggcatggtggcagttgcctgtaatcccagttactcaggaagctgaggcaggagaattgcttgaacctgggaggcggagattgcagtgagccaagagtgcgccattgcactccagcctgggtgacagagcaagactttggctgggtgcagtggctcacgcctgtaatcccagcattttgggaggccgaggcgggtagatcacctgaggtcaggagtttgagaccagcctggccaacatgatgaaacctcgtctctactaaaaatacaaaaaaaaattagctgggcatagtgcctgtaatcccagctactcaggaggctgaagcaggagaattgcttgaacccaggaggtagaggttgcagtgagccgagatcgcgccattgcactccagcctgggcaacaagagcagaactctgtctcaaaataataataataaaataaaaataaaaaagttaaaagtatggtgtgtatatatatatacacacacacactcatacaaacacacacacacacacacacatatatgtacatgtatagtatcagccatgaggtcctgccagaagatgacggctcctaatgccacttcccaacacaagagttcagtgcccacatatgcaaggctgagagcctcacaaagagcagggcaaggtacacacatcagtgatataaagcatataggatacaatatatttatacaacatggaggggatttacatgctatctaagcaagaaaggtattacacatctatcttcctacacgtagaaatgtagagtagtttagtaatcaccatgcataaatacatagaatggataactatagtggttacataaatattgaaagaatgatgaaaaaatgtagaatagtgctaaaattaattctaagtggagaaatgatatagatatagatatgcaaatatacacacatatgtctctctgtaaattggtaaagttatacatttgcatatatatatcgcagttggataaatataatgtttaaagggacattatttatagaaatactataaagtatggggcacagtggcctgcactgtagtcccagacttgggaagccaacctgggaggatcgcttgagcctaggagtttgagaccagcctgggcaacataacaagaacttgtctcaagaaaaaaaagaaaggccgggcgcggtggctcacgcttgtaatcccagcactttgggaggccgaggtgggtggatcacgaggtcaggagatcgagaccacggtgaaaccccgtctctactaaaaacacaaaaaaattagccgggcgtggtggcaggcgcctgtagtcccagctactcggagaggctgaggcaggagaatggcgtgaacccgggaggcggagcttgcagtgagccgagactgcgccactgtactccagcctgggtgacagagcgagactccatctcaaaaaaaaaaaaaaaagaaaagaaaaaaaagaaaaaggtaaaaaataccatatattcactttttttttttttttttgagacagagtctcactctgtcacccaggctggagtgcagtggcatgatcttggctcactgcaacctccacctcccgagttcaagcgattcccctgcctcagtctcccaagtagctgggattgcaggtgcccaccaccaagcccagctaatttctgtatttttagtagagacggggtttcaccatgttggccaggctggtctcgaactctggacctcaggtgatccacccgcctcagcctcccaaagtgctgggattacaggcgtgagcaaccgtacctagccacacatttcttgatagataagatacataaagttattcaataaatgtatatccagatacttaatggttagggaagcttagttaaggcacctggacaccaggaaaacatgcttttcccaccaaaagctccagatggtcctgtccggtcctgtccagtcctgtatcaagatgccagtggggaaactgagtgcctgttgaggcaggcacccaggaggcagcacagccagtgaggagaagggaagggatatacaggaatgtgaagtttatggtattcgaggtgcactgagcacgctgtgtacgaagggctggcctaagccctgcaggggcattattcatctcatcttctctaccctgagatggatgataccatcatccccaagttatagtagaggaaaccagggcccaacaaagaaaagctgccacaccagcaactttataaatctttacaatgatgtgagaatttgtgggctagccagatttttaaagaaaacttcaagtttgagcaaatttgcagacactcaaaatctactctccctaacctggaagtgtctctgcaaaaataaaaacaaataaaaagtaaaatgtcatgacaattagtggactagtccggatttttaaagaaaacttcaggcttgagcaaacttgcagacacccaaaatctacttcctgtatcctgagagtctgcaccagggagagcagtggggagggtggaactgatgccgaactgtcctagaccgcccccttctggccagaggaggtgggctcagctgtctccatgaacaaaaaccgccctctcttggctagaggcagaggccagtcctcaataagggccctgtgtgtgtgtgacaagatgcactaaccactcgcttcgtgcctagtggggctgtggccagggtggggcgttgctggcttggcctggagaggggacacaaagggacacatctgaagccacagaaatttcagaaacaagcaaatgcagggtcactgggagacacctggacactgcaaagatgcagagataaagaaggaaacaacagttcagcagagggagagagagagatggagcaaggacagggagagagacacccagagagagatagagagactctcccagacaataccaaccaagccagagagatgcggaaggactgagatacacagaagccgtccccgccccggccctgcaccccaagacatggtggaaaatgaagcatcttctctgacctgagctgagacaggcagggagcccctagcaggaagagctcttcccttccccatcatgtggtgtctagacagtcttcccgccccagcccaacacccgatttcagaagctcccaggagctctgcatcctagtcctccgggatttgttggtacaaatgggcttgctgtgggtctttccccaggatgggctaggactctgtctgtggcagcaggcccagtttcccagcttcctaaattccactgccatgtctctttgcctgtctcattctcctggtgagtatgcttgccttttcacacaaaaaatggaggtttcctcccaaccagctctgtcccactgaggctgataaagaactgtgaacctggctgggcatggtggctcactcctgtaattccagcactttgggaggccgaggtgggtggatcacttgagatcaggagttcgagaccagcctggccaacatggtgaaaccccgtttctactaaaaatacaaaaaatagccgggcgtggtggctcacacctgtagtcccagctactcgggaggctgaggcaggagaatcgcttgaaaccgggaggcagaggttgcagtgagctgagatggcgccactgcactccagcctgggtgacagagcgagactgtctcaaacaaaaacaaaaacaaaaacaaaaaactgtgaactttgctgggcatgatggctcacacccctaatcccaacactgagaggctgagatagggggatcacttgaggccaaaagtttgaggccaggttgggcaacaaagtgagaccctgtctctgtaaaaatacaaattaaagaactgtgacttggagatgccagtgactcttcctgggctttgatgaagaccccttcctggctgaggaacagaacctgtcccaacctgcctggaccagccctggggcctcatctggcccccacccagtggccaaggctttattatcagaaccaggactgcctcctcatgagtgcagcctcctgaagatggctgggaagtccatcagttgaaggcctggggaaggaggagatgtgaactcctcctcagtcaggagatgacatttacctgcaatcttcctcttatcttcccccacccgtaggccacattcagcattcttcaacaaacactctgttgcctgtgcccagagacccagatgctggaacctgaccgcccggatctaattctagtcccaccacttaccagctggctgacttggcaggcaacttcacctgttgtgcttccgttttccatagataagatggaatctggctaacatcaacgtcactgagcaggctgggtgcagcaactcacgcctgtaattccagcactttgggaggctgaggaggtgggaggatcacttgagccaaggaatttgagtccagcctgggtaacatagcaagacaccccccaataaagaatcgagcctgcccagcctatgggtgctgattgctccaaacaatccctgcattcccccataaagtccaggctgcccgaaccatggccagtaatactggagaacaacccctccaaccgagctgcccaaactggctgccaatccgcaagaacggccccttatccagcctgcacccccaccctctccatggctgctaatcctggaaacaatccctctattcccacttcagaagctggctgcgcctcccccatgagacacctctgcgccctccccgaatgagccgcacgtctgcttctccaaacggccgctgtgcccggtgctcagcgcatctcaactcgcggcaggccgccccgcgagccgcctctccctttcctgcggctcgaagggaccccagcgtgaaccgtgtgcttgtttttcattgtctccatctcggggcttccttgtagagtttggagctccgcgtgaacagcgctctacgcgctagttccatcggctcctcggtgcccgcacgcagccgcgcgtgccagtcagtgcctgggtcaccgcgaattccatcccaacccgctccggcaccgcgacggtctctcctgtcactggagacgtttcttgtgtcagtgcaaatatatgtcgttccttgtttttttctattaaagacagtgcttggtgggaacatttctgcactactggagtttctgaagcttcaaccccacgcaccaggcccacccacacccgggcccccgttcccccgcccgacccacccacaaccagccacctagctcagatcccggcccatgatctgcaccccacgcccgccccacactcaaaaccgctccccaaggccgcctaagcccgcaccccatggcctgagtctcctcccacacccggctttccccgtgcccagcaacttctgcaatgcccgatcccccagtatcctggccccctgcattccagacccccacaccctctagccatcgtcccccacgtcccggccccaccccatgtctgactctcccacgcccagggcctccctcacagctttccctgtcacactttggtcaccttcccacacccagacccctgcccagcgctgggcccaccctagttccaggccccctccacaccccccaaacctcccctacccacacacacccaggggctctgccaaggctcttgggggtttggtggcagcaatgtagttaatgagcatcctcaattcaaagaatgttcaagactgcactgcactggagaacgtgagagccctgaaatcttgctgctcctatgtgaaaaacacttgaaagaggttttcccaaatttgacaatatccaaaactttcacattagcaatggggagcatatattcagggcaactggtatggggggaaatgttagcaataataagtggtgaactggaatgcacattttctaagctattagtaaaaaaaatttaagagagggagtcggctgggcatggtggctcatgcctgaaatcacagcactttgggaggccgaggcgggtggatcacctgaggtctggagttccagaccagcctggccaacatagtgaaaccctgtctctactaaaaatacaaaaaaaaaaaaaaaaaaaatcagctgggtgtggtggcgggcgcttgtaatcccagctactcgggaggctgaggtaggagaactgcttgaacccaggaggcggaggctgcagtgagccgagattgcgccattgcactctaccctgggcaacaaaagtgaaactccacttcaaaaaaaaaaaagagagggggtcaatcacaccagaagacccgtttatccttcattctttctcaaagaaattgttataatattctaaatcattatcatatgaagcagtgatcatgattatgcagttactggtagcagcaaaatgtaattatgagggaattaattttaaaatttatcttttggaattttgttatgctatgcttttgaaaatttgcagttgttttgcttttgtcattctaaaatcattcttttatcattataaataaatacaaactttgagacaaactgattatattcagaattctgtgctcttttcttttttctttagagatagagtctcactctgtagcccaggctgtagtgcagtggcgccatctcggctcgctgcaacctctgcctcctgggttcaagtgattcttgtgcctcagcctcctgcttacaggtgtgcgccaccatgtccggttaattttttttttattttttcgagatggagtctctgtccatcttttgagccgagattgcagtggtgcaatctcagctcactgcaacctctgcctcccgggttcaagcagttctcctgcctcagcctcctgagtaactgggattacagctgcgtgctgcccggttaatttttgtatttttagtacagacggggtttcaccatgttggccaggctggtcttgaactcctgacctcaggtgatccgcccgcctatggcctcccaaagtgctgggattacaggtgtgagctactgtgcccgcccggcctaatcttgtgttcttttcttagagataactctacctatggtgccaacttcagctcccactttcagatctgccctcctcctctaggggcaggtgtgtccggtcctggggcatccctgctgagcaccacgtgtgcacaacttcagctttcagagacaatgttgattgttttctaaggcaggtgtgccaatttaggactggaaatgagtcccatgcacccccagtctgcccaaacccaggaacctagaggggtcctaatcacctgtgtcagtgaaaaggtggaaaatagcaaactctacccatccctcagagcaaaatggtttctccaattcctctgtggtgcaggctataaattcagaccctcagtgtggaaaatcccaatgttgatcattagaagttaatatattaaaatattttaccagtttattaagaacttagaggcaaataatagctctcaagaatttatacatcaaaccacaagacattttaattttacattatagaaaaaacctggtgctctatttttaaaaacatgattggatttttttccccattgtttactaaatttcgacttcttcaatagttctttctggtttggtaaacattgctctgagtcacttctccttctcttttgtagtctgatcataggagagcacactaccagctccctttgtttactggggaggccaaataacaaatggttggtattttatattagctactgctgtggagacaacaaatacatgtggagctctgattgcatttgaatctaggtttcaggtggccacaaattcaataatttctttaacttatttaacagacaagcctctacaaactactgacattcatggtcacattctatgccaacaaacacagaaccaagacctttccaaatcgtagtgtcgtgggattctttcaactttaacattcagtgccagtaaaaacattcttttattctactcctaccaagtaaataagtgattccccttatcagatgcttaatctcatcataactaacttatttttataaagatttagataaaggagttcagtggagagacatttattggaatgaaccactggtttgagataagaaacccttttcataaattatgccttaatctaaaatctgggtaagtattttacttcattggctcagtttaactggaggaaatagcaaagagaaatttatgactatggcttataaatatttaaaacctgtttcttcagaaacagtgatcaaggattactgagaaaaaaaaaaagaaaacctgtttctctcactgactgactctgacctctgagaaagctgtctctctgccccagcactctgcctcacagcctgctttatgaatcttcactacacccgtcagtcaacactgggaagataacacatctatttcttcctcccactctaagcccactgtgatatcatccattggaggcaggagctctgcgctgtccctttgcagcccctggaactgcagtgagctgtgtgtattgagtcaatccataaataccaagtaattatataaataaaaattataggagacccttgttttggactaagctcctgctaggatcagcttagtcctaaacaagggtctcctgggtggatcacctgagttcgagaccagcctgaccaacatggagaaaccgtttctactaaaaatacaaaaagaattagccaggcgtggtggcacatgcctgtaatcccagctactcaggaggctgaggcaggagaatcgcttgaacccgggaggcagaggttgcactccagcctgggcaacaaaagcaaaacttgaaactctgcctcaaaaaaaaaaaaagaaaaagaaaaagaaacaaacaaaaaaaaaacacaggggtctcctataatttttatctaacataactttcaaagcattttcattctaatacaattactccaaaacagagtcacctctggccttccatcaggagagagataacagtccaacttcccaaacaggccagcttcagtggcatgataatgaagttccctctgcctttaatccttacaacaaaaagggacccgaggttagtcaatcagttcttttttctattgttctgtctcattcttgccttaggaggaaagcaaccttaaaacgaccaattcactttttcttttttgtttctgctttctttagccattttggtctataaaaccaacctcctctgctcagttccctggaacatttattccattttatgaaaggaagtgttgccttatttgagaatcacaaagccaactaagaatttttaaatgggccaggcacagtggctcactcctgtaatcccagcactttgggagaccaaggcgggtggatcacctgaggtcgggagttcaaggccagcctgacaaatatggagaaatcccgtctttactaaaaatacaaaattagccaggcgtggtggcacatgcctgtcatcccagctactcaggaggctgaggcaggagaatagcttaaacccaggaggcggaggttgcagtgagccgagatcacatcactgcactccagcctcagcaacaagagcgaaactccttctcaaaaaaaaaaaaaaaaaaaaaaaaaggagccaggcacagtggctgatgcctgtaatcccagcactttgggaggctgaggcaggtggcccagtctccactaaaaataccaaaattaaccgggcatagtcacacacaaaccctgttggctaggctggtcttgcactcctgacctcaagtaatctgggccaacactgtaactgcccaaggggttcaccttgcccactgcgtagacagagccaattcatcaagacaaggaactgcaatagagaaaaagtaattcatgcaaagccagctgtgtgggtggctggagttttatcattactcaaatcagtctccctgagcattcggggatcagagtttttaaggataacttggtgggtagagggggagccagtgagccaggagtgctgattggtcagagatgaaatcatagggagtagaagctgtcttctagcactgagtcagttcctgggtgtggaacacaatgtcagacaagccagtttattgatctgggtggtgccagctgatccacaagtgcaggtctgtaaaatatctcaagcactgatcttagcagcagtttagggagggtcagaatcttgtagcctccagctgcatgactcctaaaccattatttctaattctgtggctaatgttagcctagtccccaggcaagaaggaagtctgctttgagaaagggctgttaccatctttgtttaaactataaacggcaagcaatcctggcgaggtggctcacctcccagcactttagggggcaggtggattacctgaggtcatgagtttgagaccagcctgaccaacatggtgaaacccccgtctctactaaaaatacaaaaaaattagctgggtgtggtggtgggcgcctgtaatcccatctactccggaagttaaggcaggagaatcccttgagcccaggaggcagaggttgtggtgagctgagatctcacctaggtcctgccactgaactccagcctgggcaaaagaacgaaacttcatctcaataaataaataaataaacaaacaaactacaaactaagtttttcccaaagttagttcagcccacatccaggaatgaacaaaggcagcttggcagttagaagcaagaagtagtcggttaagttagatctctttcactgtctcagtcataattttgcctaggcagtttcaacatggtgaaaccccatctctactaaaaatgcaaaaattaggctgggcacagtggcttacacctgtaatcccagcactttgggaggccgaggaccaaagtggatcacctgaggtcaggagttcaagaccagcctggccaacatggtgagaccccctctctactaaaaatacaaattagcctggcatgatggcaggcgccagtaatcccagctactcgggaggctgaggtgggagaactgattgaacccaggaggtggaggttgcagtgagtcgagatcgcaccattgcactccagcctgggcgactaagcaaaactccatctcaaaaaaaaattagctggctgggtgcggtggctcatgcctgtaatcccagcactctgggaggctgaggcgggcggatcacgagatcaggacatcaagaccatccaggctaacacagtgaaacccaacacaaaaacaaaatcagccgggcgtggtggtaggtgcctgtagtcccagctactcaggaggctgaggcaggagaatggcgtgaacctgggaggcggaggttgcagtgagccgagattgtgccactgcactccagcctgggcgacagagcgagactccgtctcaaaaaaaaaaaaaaaaaaaaaaattagctgggcgtggtggtacatacctgtagtcccagctactcaggagactaaggtgggaggatgagttccaaaggcagaagttgcagtgagctgagactgcaccactgtactccagcctgggtgacagagtgagattctgtattaaaaaaagaaaatggggccaggtgcggtggctcatgcctgtaattccagcattttgggaggccgaggcaggagatccacctgaggtcaggagttcgagaccagcctgaccaacatggagaaaccccatctctactaaaaatacacaattagccgggcatggtggctcacgcctgtaatctcagcactttgggaggccgagacgggtggatcacgaggtcaggagatcgagaccatggtgaaaccccgtctctcctaaaaatacaaaaacttagccgggcacagtggcgggcgcctgtagtcccagctactcgggaggctgaggcaggagaatcgcttgaaccgggaggcggaggttgtggttgcggtgagccgagataacgcccttgcactccagcctgggcaactgagcaaaactccgtctcaaaaaagaaaaaaagaaagaaaatgggcccaccgcagtggttcatgcctgtaatcccagcactttgggaggctaaggctggccgagcacttgaggtcaggagttcaagaccagcagcctggccaacacagtgaaaccccatctctactaaaaatacaaaaattagccaggcgtggtggtggactcctgtaattccaagataagggaggctgaggcaggataatcacttgaacctaggaagaagagtttacactgaactgagatcgtgccactgtactccagcctgggcaacacagcaagactctgtttcaaaaaaaaaaaaataatgcttgggaccagagatatttctgattgtggaattttttggattttggaatatttgcatatacataatgagatatcttgggaatgggacccacgtctaaataatttatgtttcatatataccttatacacatagcctgaagatgattttatatatttctttttttttttttttttttttgagacggagactccttctgtcgcccaggaggagtgcagtggcgcaatctcggcttactgcaagctccacctcccgggttcacgctgatctcctgcttcagcctcccgagtagctgggactacaggggcccaccaccatgcccggctaattttgtttttgcatttttagtagagacggggtttcaccgtgttagctaggatggtctcgatttcctgacctcgtgatctgccctcctcggcctcccaaagtgctgggattataggtgtgagccaccgcatccagcagatcttatatatttcaaataattttgtgtatgaaacaaagttttgacttttcaatatggcctgtcacatgaggccaggtgtggaattttctacctgtggcgtcatgctggtgctcaaaaagttttggattttggagcatttttggatttcagattttttttttttttttttttttgagacagggtttcactctgttacctaggctggagtgcagtggcacaattacagctcaatgaagcctgatctgctgggttcaagggatcctctcacctcagcctttcgactagctgggaccacaggtgtgcaccaacacacctggctaatttttatattttttgtagggatggggtttcaccatgttgcccaggctggtctcaaactcctgagctgaagggatccacccaccttgacctcccaaagtgctgggattacaggtgtgagccactacacccagacaaattttggatttttggattaggtatgctcaacctgtatgttgaaaacaaggtgccagggaacaggctctcagtgactgcaggcatcaggtgatgtgccagggagacacagaaaggaagaggagtgtttcaacatgtggccagtaaaagacttccaagaatggccgggtgcggtggctcacgcctgtaatcccagcactttgggaggcccagatgggcacattggctgaagtcaggagtttgagaccagtctggccaacatcgtgaaaccccatctctacaaaaaatacaaaaaaattagccggacatggtgatgttcggctattcaggaggctgaagcaaggcaggggaattgcttgagccagggaggtggaggttgtagtcagccgagatcgcaccactgtactccagcctgggcgacagagcaagactcagtctcaaaaatagaagacttccaagaataaaaatatattacttaggttaagttcggtgggtgacagaggaaggaaatagactcaactcaggccaaaaaaaaaaaaaaggaggcggcaatatggagtaactaatattaaacaagagttaagtaaatcttcaaatggagatttggaataaaaatagtatggtgcaacaagagcgaaactccatctcaaaaaaaaatggtatgtatggtgttcagattccactagatatattacaactcatgtagccattttactttaaaatataaatattaaaacataccagaaattgtatcttttgcaactatttgagcttatgatgagaaactttagcaacataaaactgtggaatggatatgtggtttttcagaaatgagagcaaacattcaaagactactctattacataaatacgggaatagaagagtggcccagaaacgaaatagcaggagcttctagggttcagcaagagagggctgagggagactgcccaagaagggattgaagcggggcctagaatgccaaagcttgtactgcactttacgtgtgtcacaggaggacagaaaggggtgagtcacagagctgtttaggaggcagaatggacaagaattgtttgattggttatggggatttggaggcaaataaagtctaggatgatgctcaggccttcggctttaccacttggatggagcacagagagtaggcggggtggtttaaagaagaaaccaagtatttatttcaggaaatgtcaagtttcagcaaactatgagacatgcatgtggagacaggaggcaggcagtgggcctggtggtctccagctaaggagagaggtcagagaggtgagtttccaggagggagcagccaaatctcagagcctgctgagggggttaagacctaattatccatccaaaagtgtatccatccacccaaatattactcagttattttatttatttttgagacagagtctcgctctgtcgccaggctggagtgcagtggcgcgatctcagctaactgcaacctccgcctcccgggttcaagcagttctcctgcctcagcctcccgaggagctgggattacaggtgcgccaccacgcccagctagtttttgtatttttagtagagacggggtttcaccatgttggccaggatggtctcggtctcttgacctcatgatccaccagcctcagcctcccaaagtgctgggattacaggcgtgagccaccgcgcccggccaatttatttatttttattgagacggggtcttgtcattttgcccaggctggtctcgaagtcctgggttcaagggatccacctgcctaggcctcccagtgctgggattacaggcgtgagccatggcgccctttctactcaagtgatttatcaatcattttactcaatagttaattcacacatccatccagttcccacaatgaattccatccatgtgccaaggtctctgggacaggaagctgagtgacctgaaatcacagccctgggagaaaagggaggtgagtggtcaagacagatacacccatacctgtgatgtggggtttgggaaaggtgggcctcccagaggggaggcaggtgaacaggaaaggtggcttcccaggtgaggcaattgttgaattggacagagtggaaatggctcacagtggtccttgggagaggatgagaattaggatggagagaaaagattgaatacgtgagatatggaagaactagaaggatgggctctcactgggggggcgggggggacagggaaccgagttgcctaacttccctttggtggagtcagactgtatgctgagcgctgtgactttggaccactgtccatgtccttgagggggtcatatcctgaggagctggcacacatttcagcagatatctccatatgactgggtttagtggtggcctgtgggaccacgtgggaaagagacccacctgagatgggaaattctgaaaggtcagagatggtgggggaacggaaaagtttaacagttgttgactgtgaagtgcctgcaggaaatgaaagggaggtgcccaagagctaagaagtctggtataggagaagcatgagtaggagctgcaacagggggctaagaggtgacctgtgcagtagaaggaaagcactcgcgttctcccaggtgcggaacgagcaaacgttgatgacaaatgactttgcctaccatcttgaaccctttcggcttctcttcttgcacaggtcttcattctcaccctgctacacagcccctaccagaacgttctgaaatgcaaacctaacaactgtctcaccccagcaggaaactccccagggtcccgggccccctgcggggttgcaggcctcactcttcgcgcccatccctccgccctgaccgccctgagctcgcccccagtgctggcccttcacgtccagttatccctcccagcctccaaggtccccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctgggccctcgcctcactggcggtttctcccgcgagccagcctcatagacattccttggtgctgattggctggcggccagcgcagtcctccttcctctggctctctcgcggccccttgcgggaaggcctcccagaggccgtggggtcgtttctggcggcctaagtgggcctaacttttagagtcccgagggtcgtcgctgccggggagatctccgccccatttccgtgccgccttgtcctcagggcccaaagccccctgcgctaagggccctgtcccatctctgccctacacgcgggagtcagcctaaggcggagccctaggacagcagccgcgcctgacgctgctcgcctgcctagcacaggcagggggtgagcggagtcggctgcctccctccccagggccctccaagggagtgggctccacatccatgggcccgaggaatctgcggagagacgggaagagcaggggacactcacagggcgggggtccaggcgggagtccagtagtcctcgtggagacagctgggaaaggcctcggggcaagggacctcggatttcctcctctgcctcaaaacagacagtctaagctgggtgcggtagcttgcgcctgtaatcccagcactttgggaggacgagttgggtggaccaccaagtcaagagatggagaaccatcctggccaacatggtgaaaccccatctctactaaaaattagccgggcgtggtggcgcgcgcctgtagcccctgctacttgggaggctgaggcaggagaatcgcttgaacctgggaggcagaagttgcagtgagccgagattgcgcctctgcactccagcctgacaacaacagagcaagactccgtctcaaaaaaaaaaaaaaaaaaaatgaccacgcacaggcagcaaggggcagggggtggtccacgctcagccttcagtacacatttgtggaattaatccctcccaggacaggttgtgaagaaagcttgttaacctcaagattcagaagcaccgttcacagcacaagctttggagtcaaattcaggctgttaacttgctgcgtgcgcccccgacttacctctttctgcctgtttgctcatccgtaaaatgggaactgtgactgagtctactttgaatctgattatgctgcatgaactcagaagacagggctcagttgagtgactgctcagtttacaagagctgttactgtagttgggaagcgccctgagacatacatggtaagattggtaacctaggataaagggggccaccatgagagagaccccagagggaaactgttccagagaagagaaatgtcttgctaaggtcacactgccctggtagcgagcacagggcagcctgctccgcccaagtttccagccttctcagctgagttctggcccatcaggctaagccggagactaagcctcaagaaagcaggcattcgtaggaaaggggtcctgtaagtcccaaaagccacctttgctttggaaggtctccaaaaggaacctcagatgcacttctccagaaggccctagcatttttgcctgcccccatccccaccccgcaacaacttctgccctcttcagggatccaccattcctattcctattgctgtgaggtattataacctttaacaggtggaaagaaaacttcacctcagccaggtggtattgatacccatccaaggcaggggacaagttgaggcttggacagatccagagattgggaatccaggtctttgagtgtaccttctgcaagcacaatggtacatcacctcatccacggtgtgtaccatgccttagcactgtgtgccctctgagaggcccccaatttctggccacacactcaatctgcagcaacaccttttacactggaagtgatgcaaagtcagtccctgggttaatgaacatatcttcttaggtattaaacccagtatttataaataaatgaccacagaatggtgtagaaaactttaaaagttttggatattaagtgttggctgggccaggcgcggtggcttacgccagcactttgggatgccaaggcgggcggatcacttgaggtcaggagttcaagaccagcctggccaacatgatgaaaccctgttgtctctactaaaaatacaaaaattagtcaggcatgctggcacgtgcctgtaatcccagctacttgggagactgaggcaggagaattgcttgaacccgggaggcagaggttgcagtgagccgagatcgcacccattgcactccagcctgggcaaagaagagaaactctgtctcaaaaaaaaaaaaagtgttggctgggggtgttgactcacacctgtaatcccaacactttaggaggccaaggtgagagaatcacttgagcctggaaggtggaggctgcaatgagccgtgattgtgccactgcacaacagcttgggtgacagagtgaaaccctgtctcaaaaaaaaaagtgttttttcatccattaggagtgtttggatgaactctctcatggtgtgattcctgagggttggactggcaatgaaggctgtgttcaggaagtttcttgccctgcttcctggacatgcgtttcttaccaaaactcctggagcgatgcattggaatcggacttcttatatagtacaaatatgggaaagctgggtgagaggcactgaaacctacaggaaatcaaaccttgggtgatgagactggaagggtaaaggaaaaacaacaccactttgcctgagcctcagctgggtgggtgcaggtcaaagttcggaggtatcaagacgtttcaaagagaaaattacaggatccagcttcagcttatcttctctctctggctccagcactgcaaagtatacaaaggacctggtgcagaggaagggaagtctgtggtccagagtggcacctgaagatgagcatttcgcaactgggactcctccctgccacctggcctcccctactcaatgagcttttccctgttgctctatgaagaacatagatgtgtccatgaaggtattaatttccctgaggaaaggtaataaagactggaatgtacccagatataaaataaaagggaagtggcaagtatcttacctggcacacagtgggaacataacctgagatttctattttccaagatggactgaacgtcacaggcatcagtagaaggctgagatggtctattttgaggagtgctgtacgtgttcgcgtgtgtgtgtgcacgtgcacacccatacacacacacacacacagactgagattttaaaagacccagtaaagccacacccagtggctcgtgcctgtcatcctagcactttgggaggctgagttgggaggatcacttaagaccacgagttcaagaccagcctgggcaacatagggaggccccgattctacaaaaatttaaaatattgattgggtatgttggtgcatgcctgcagtcccagctacttgggaggctgaggtgagatgattacttgagcctggcagcgggtcaaggttacagtgaaccatgatagcaccactacacaccagcctaggtgacagcaagaccttgtctcaaaaaaaaaaaaaaaaaaaaaaaggccaggtgcagtggctcacacctgtaatcccagcactgtgggaggccaaggcgggtggatcacaaggtcaggagtttgagaccagccttgccaatatggtgaaaccccatctctactaaaaatacaaaaattagccaggagtggttgtaggtgcctgtagtcccagctacttgggagggtgaggcaggagaatcgcttgaacccgagacgaggaggttgcagtgagccgagatcacaccattgcactccagcctgggtgacagagtgagactccgtctcaaaaaataaaaaataaaaaaaaagacctgggagacccagacagaaagtgggagaaaatataccctgctgcagtgacaccaccctcagagaaaccacgatggcaagggagctggctcaggacattgagtcctcaaaacaatgctttcactagtctcctttaataaatgaagaaaccgagacccaaggaggtagaaaccttctccaatgtcacctggcttgggagatgggccccaagtttaaactctgctcagttactgcagagccactacattctatttcctgcatagagaatggctgggggacacatgcccagagaccagcagagagagagtgggaggcagaggccaggaaacacagggtcaggcaggccaagatctgccctccaggagaccatggcacccagagaggccacaccataaaaagcacagcaaggctgggtgcagtagctcatgcctgtaatcccagcactttcgggtggatcacctgaggtcaggagtttgagaccagcctgaccaatatggtgaaacccagtctctaccaaaattacaaaaattaacctggcatggtggcatgcgcctgtagtcccagctactctggaggccgaggcaggagaatcgcttgaacccgggaagcggaggtttcagtgagtcaagatcatgccactgcactctagcctgggcaacagagcgagactccatctcaaaaaaaaaaaaaaaaaaaaaaaagcacagtgaggcggctgccctaggcagtgagggtgtcgccatccagccaccaggctggggtcctgacctcaccatccaccctacatgtgacatggggcaagtcactcaacctttctcttcctcagttttctcacccttaaagtggggattgtgaaaataaagtttacaacacctaaaacactttaagctttaagagagatgtgactatgatctgaatcacataacatttcacaagtctgcttcttctttttttgagacggagtctcgctctgttgctcaggctggagtgcagtggcgcgatctcagctcactgcaagctccgcctcctgggttcacgctgttctcctgcctcagcctcccgagtagctgggactacaggcgcccgccaccacgcccggctaattttttgtatttttagtggagacggggtttcaccgtgttagccaggatagtctcaatctcctgactatatatatatatatatctcatcccatatatatatatatctcatcccatatatatatatatatacacacacacacgcacgcacacacacacagggtttcaccctgtcactcaggctggagtgcagtggcgagatctcagctcactgcagcctctgcttcctaggctcaagctatcctcctgcctcagcctcccaagtagctgggaccacaggtgtgcaccaccacgcctggctaattttttctatttttggtagagatagggtttcaccatgttgtccaggctgattccatatgttttaatttaaaaaatgaataaattggctgagaggagtggctcaccactataattccagcactttgggagtccaaggcaagagaccaagagttcaagatcagcctgggcaacatagtgagacctagccttcactttttttttttttgagacggagtctcgcactgttccctggactggagtgcaatggctgatctcggctcactgcaacctccacccactggcttcaagtgattctcctgcctcagccttccgaatagctgggattacgggctcccgccaccatgcccagctaattttttgtattttttagtagagacgggatttcagtatgttggccaggctggtctcaaactcctgacctcgtgatcctcccacctcggcctcccaatgtgctgggattacaggcgtgagctaccacccccagcctgactcagccttcattttatatacaaatatttaaattttaaataaataaagtgttaaatagaacttcctcctaaagaaagactacctcaactgatcagatcattttttttttgagatggagtttcactcttgttgcccaggctggagtgcaatggcgcaatcttggctcactgcaacctctgcctcctaggttcgagcaattctcctgcttcagcctcccaagtagctgggattacaggcatgcgccaccacgcccggcgaattttgtgtttttagtagagatggggtttctccatgttggtcaggctgatctcgaactcccgacctcaggtgatccacctgcctcggcctcctaaagtgctaggattacagacgtgagccaccacactcggcccagatcattataactatgcattaaaccttaaattttaaaagttaaaattcagccagcggcagtgggtggctcacatctgtaatcccaacactttaggcagccaagggaagtgaatcactagagcccagaagtttgagaccagcctgggcaacatggcaaaactgtctctaccaaaaaaaatacaaaaattagcctggcgtggtggcgtgcacttgtagtcccagctacgcaggagggtgaggcaggagaattgcttgttccagaaggtcgaggctgcagagagccatgactgtatcattgcacttcagcctgggcgacagagggagaccctgtctcaaaaaagattaaaaaaacagctaaaatcctgttaaacgttcctaaactgtgtctatataaacgatcccaggccaggcacggtggctcatgcctgtaatcccagcactttcggagtccgaggcaggtggatcacttgaggtcaggagtttgagaccagcctggtcaaagtagtgaaacactgtctctactaaaaatagaaaaaattagctgggcatggaggctcgggcctgtaatctcagctactcaggaggctgaggcacaagaatcacttgaacccaaaaggcggaggttatagtgagcagagatcgtgccactgcactctagcttgggcaacagaatgactctgtctcaacagaatgagactctgtctcaaaaaaataaaaataaaataaatgatcccaaacttctacattttacgtatttattgtgagacaggtctccctctgtcacccaggctggagtgcagtggtgctttctgggctcacagcagccttgacctcccatgctgaagcgatcctcccacctctgctggagtataggtgtgtgccaccacgccaggctgtttgttctatttttttttgtagagatggggtctcgctatgttgcccagactggtctcaaactcctgggctcaagtgatctgcccaccttggcctcccagagtgtcaggatttaacccccacactccaccgagactttaaaactctgacttccattcttctctttttttcttttttaagatggagtctcgctctgtcgctgaggctggagtgcggtggcacgatctcagcttactgcaacctccgcctcccaggttcaagcgattctcctgcctcagtttcccaagtagctgggactacaggagcgcgccaccacgcccggctaatttttgtatttttagtagagacggggtttcaccttgttggccaggctggtcttgaactcctgatctcatgttctgccctcctcagcctcccaaagtgctgggatcacaaccgtgagccaccgcccccagccatgacttccattctttaccatccttacttcctgagcaggccatccttaacctttacacttaaataaactcctttaaactaaaatctaacctgtttgactattgtagattgacaggctaatgagagtatgaacctccaaagacttctgtgagggctaggtgcagtcatatatgcaatgaactcaagtaaacagctggctgaggaaacaccgggacgcctcctctgtgctaagccccatgcagcatgcacacagacacaggcccacctcagcctcccaaagtgctggggttacaggcgtgagccgcctttcccaaccaatattttatatttttacacaagtgacagcatcctattcagactgccctatactttttttccacttaaaagtatgtctgggccagacatagtgtctcacacctgtaatcccagcattttgggaggccgaggcagtggatcgcctgaggtcaggagctcgagaccagcctgctcaacatagcgaaatcccatctctactaaaaatacaaaaattagctgggcacagtggtgtgtgccggtaatcccagctactcgggaggctgagacagaattgcttgaacctgggaggtggaggttgtggtgtgccaagatcgagccactgcactccagcttgggcgacagagcgaaattccagctcaaaaataaatatataaataaacaaacaaaccaactaaaccatcattgccctccccagccctcccagcccagagacccccatcccttgtcagccatccccccttaccttctggacagggacaagtgtccctcatttggaaaagaattaaggaggggtaacagcagactagggaggcctggggtcctccacacgcctgtgtggggtgactttggcccccagcaacaaggcaggcctgaggtctgcagagggaggcagcccactcctcagccgggggcgtctatcctcctcctggccccatccctcacctgtgggggaggctaagtgggtgtcagggccctgtcagagggtgagccacccccgggggtgcccatcggccaccagcctcccttcagtagacacccagcccaagtgacagcagtggcatggcactgctgagcacagggagcctcaaggtcagtgcctggctcctggtatcctccgtggtccccaggacacccccacacagaggtcccagaacccccaaagctggcacaagagcccaggaacaccctgcccagcaccctccaggtccctcttttaggatctgggtgagctaaagaagccaaaagaaaggctgggcgcggtggctcacgcttgtaatcctagcactttgggaggccgaggtgggcggattgcctgagctcaggagttggagaccagcctgggcaacacattgaaaccccatctctactaaaatacaaaaaaaattagccaggtgtggtggcgtgcacctgtagtcccagctactcgggagcctgaggcaggggaattgcttgaacccaggaggcagaggttgcagtgagctgagattgcatcactgcactccagcccgggtgacagagtgagactccatctcaaaaaaagaaaaaaaaaaaaaaaaaaaaaaaaaaaagaagccaaaagagggtcttcggcccagcccgcccctccccaacagccctgggtgtggcagggagcctgaccagttccctccagcctgcgtcatggagccctgggcgtggctgcagggtttaaagagccgacccacgtgcccagcagcctcctcagatccgttctctgcgctgccagctcaggtgagccctcgccaaggtgacctcgcaggtgagcaggcgtccactttggggctgctgggtgaagggggtgggtgcccaagaattctgagtaatgaggagcctgttgaggggtctgaggacagatatggctgcagcagccgcttgaaggcctcctgctttgcacccactatcatatggatggtgggttgggggttggaggaaacagaagccagcccttggctaaagaatatatgagctggtggggtatacctctggtcccaactgcttgagatactcaggtgaggagatcacctgagccaagagagttcaaggctgcagtgagccgagatcacgccactgctctccatcctgggtaacagagcaagaccctgtctcaaaaaaaaaaaaaatagtaataataataataataaaataaaaaatgtgacctagagttgagaccctcgtattccaggaactccaggttggtgaaggtagagagaccagtgaaggctgggggaagccagctttggagactgctcctagcccaagaaccgatgttcagaagcagtgcctaacagtctctccctccagtgcctccctcccactgcagaaggaccatgtgtttatttatggatgtatttatttatttattttgagatggagtctccctctgttgcccaggctggagtgcagtgccaggatctcggctcactgcaacctccaccttccaggtttaagtgattctcctgcctcagcttcccaagtagctgggaatacaggcgcctgtcaccacactcagctaatttttgtatttttagtatagatggggttttgccatgttggccaggctgatcttgaactcctgacctcaggtgatccacccgcctcagcctcccaaagtgctgggattataggtgtgagccactgcgcccggcctatggatgtatttattgtaacaggtttttagtgcttactgtgtgctaggcatagttcttaggcttgacaaatagtagttcacgtaattccatcgctataaccttatgaggttgctactattctgatgatcctccttttacaggacactggtgaaggagcagtgaggaacctgcagagtcacacagttggtaagttgctaagaagggacccagcccagacagctggccctggatctgtgatctcatcaggaggccagagctgggtacagcagatgatgacaatggcttcagtattgaaaacttgaccacactaggctaacaatatgcagagggctgggagggggcctgcgctcaaagactcagcctccctaaggacaagtaaatggggtcctggctacttccaacctgagggggaaatgtcataccacaggaggtctatactctgagagcagaatctgggtctgctggagtagggtcccctgccagggctggcaggggaggtcctggctgctgcagtcatctcatcccaggactcagcactccctccctcctccacacccttgcttttgtggaggctctctgggaattcagactgagggtgctggactctggccaccccaggcccagacctttgggaacaatagcctggggcctgataacaatgccctttgtgtggggttaggaaggcaggctccagaccctgacttagaatagcagccacctgaccctgggcatctgattacacctctctaagctccatttttttttttcttctctgaaatagagacaataatagtatcttcctcatggggaggagtagggggtgggtttgtcgcatggattttaacaacgccttctacagcacttactctgtgcaggcacagttttgagctcttagcttgtgcttactcaatccacacaactcccccaggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggtgagtcctcccagtctcctgggaccctcttgcattcaccccacccacaaaggcagcaaaagccagacaacatctcctttgggagtctggtgttcaatcagcatgctttatttaaactgccaatttagagagaaacatgaaggaaatgacagtacaggtaggatgagaatattgcaaaaaggtcctaatagctccagaggaattgaaccatggaaaacattaaccacctgtggcttgaagacaaaagcagggtggcacagcggctcaggcctgtaatcccagtgttttgggaggccaaggtgggaggatcacttgagcctgggaggatcacttgagcctgggaggtcgaggttgcagtgagctaggattgcaccattgcactccagcctgggtgacagagagaggttccgactcataaaaaagacaagcattccctgtttcttcagggggcagagacataacaaaccatcccagtcagcatgcacacaggagcatcaggaagcctgggacagcagggcttgggcggggccacaccctgaggctgtgtggggctggggagggcgtgaggaagggaactggtggctccagggtcaccccacaacctccgggctggggtcctgctgtctggcttacttggacaccagtgtcatgaattcccacacattttctctgctcctcccacacaggcctgactgccttggaagccaatgacccatttggtgagtgaggcccccaaacagcctgcccactctgcccacatctcccctctgacacccacatcctgtctcctggttctggttctgaagtctttttgccccactttttctagccaataaagacgatcccttctactatggtaagagctgatattcccacccccaccctacccttgcctatcctggacctctttgctagacaagttggtgaggggtagtgtggacctagtgtagacaaagtgggatgggggattaaacctggtctctgtgagagcgtcgctccaacaaggggagggtggccacaggatgcttaggaaccctcctggagaagggctggtgcctgggtggttaggcaccccgataaatcacccctaccctcttgccttcactcaccctcaccctccctttccctagtccccagccctcaggcagtcctcctctcctcctctcccctgggcctcagctccaggacagctttccttgatcatccttcaaagccctttctttgcgcatgtccacttctttttttttttttttttttttttgagacagattctgactctgtcgcctaggctggagtacagtggcatgatctcgggtcactgcaacctccatctcccgggttcaagcaattctcctgtctcagcctctcgagtagctgggactacaggcgcctgccgccacgcctagctaatttttgtatttttagtagagatggggtttcaccatattggtcatgctggtctcgaacttctgacctcaggtgatctgcccgcctcggcctcccaaagtgatgggattacagatgtgagccaccgcacccagcctcactttttttcttcttagtgtttccccacgagacgcagaatgatgcctctgttgctggcttgtctttatgtatatggcagcggctggcacaagcaggggctcaggagtgtcttttgaatgaatgactgaggccccaggctggtgcaagctcactctctgtacccaccccagactggaaaaacctgcagctgagcggactgatctgcggagggctcctggccattgctgggatcgcggcagttctgagtgagtggcaggacaggtggggctggaggacagggtggggctggcggacagggtggggcagaaagagagagtgctctcattccagcactgaccctggcgctgacccctctctctctcccaggtggcaaatgcaaatgcaagagcagccagaagcagcacaggtgagcctgaccctatggtgccctcctccttcggggcagaactacggggggacagtcctgacctggagagtggacagcatcctggccactcgctgggcttgcagctggctttgttattcagatagtcaaccctgaagggccccagtcaggaaagctctgacctcggtattgtgggaagtgaccatggaaggagagcaaggacttgcactcctggggccgggcagcaagagtctgggatataggggagaaggtcctccaggctaacctgatactactctgatgtggtcctttctctagtcctgtacctgagaaggccatcccactcatcactccaggtgagacgggcttctgtgggctgagggggtgtctgtgtaaggactgtgtctgatggcctgcccgccactctccgcaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctcctcggtagtcttgtgatccatcgtctttgggtctgggggtgggtaatcccttggattgctgactttccctggatgcccactcccagcaagcttcccagtccctgagtccctgccgcccaactgtctcctatggctcccactccagcaagccccacagagagacccatgcactgtgagataccacagtgttataacagaagacctttccatttccaccacttgcacgggggccctagaagtcctgatgcctcaggtacccatgacttcctttaatctagagcgacccccagggctcacccccccattgagacctcaattgagaccccccattgagacctcacccagtgaatgctctctatggtagaaaatgtagcaattcctttgacccatcccagtaaaatcctcagctcaccccatgggcccccctcctcccaggaaatatcctgtgaaattccatgaagaagtatgtctcgagaagccctgcatagtgcatgtgggagacaaacaccatgtgtgcaaatccaagttctttggcatgcctgaactcccctccaggaagacttccctggcaatgtccctgtggcaccccaggcaggggtgtgaagtgccacttctgcctggtgcccatcctgcagtcctgccccttgacagcccaggagaaggaactgagaccacttctagcctctgcctccagcaaaggccagagaacaatggagtccccgccaggtggcagctcccaatctgaggccagggcttgggctgggcagctgtctccaatgatgcacccttcctccatgtctcagggtgggccacatccttgagaagtatgatgtatcctagacttagggtcacctgccttgtgggtggggtcagagacttgtgcagggccccagaggtgtaaaaatgaggtccacatgtcttccagggcctttgaaacaggacacgtagggactgagagcaaggttccaaggtggggctgagtgggactaaagatacctggctgagtccagccactatcagggaatcttgggtgggtcacagaaggcctggcaagccccagtgctttggggaagctgtcctgtaccagcagccccaggtggtatggccagcccagaggcagcgctgagtctgcacaggtggacctagggaggggcctgtgcgcaaaccaccctggtggagggaattagcagcacgactggaatgcaggcgataggatcactgaggaggcaaggcccagccctgcaggacgcagaggcaggggtgggagccacccagcagggctggtagaagggggctcctgagcacgcctcctcatccagggggtgcagtgcagagctctctcctcgttggcacgggaagacgctggtgtgagagactgcttttgagaacatgaaaagtgcggtaagaaagccaagtctggagtggcagacccaggggaagccacacaaaggtgaccggaagcagtgcatgctttctgactgaggaacccagggccacgcagtcacgactatcaggagctctgctgtttgaaatcctagcaaaccctgtccttgcatggtggccccatgaccctgacaagagatgcagcctcaacttccaaccccagtgccccactggggagcagaggtttctggacgtgacagccacccacctccaccttcacatgtatcctggggccacgtcgtggtggagacctgccgctcttctttcaagctctcatgctgcttcatttaaacttctcctggacaggtgtcacagttcccccaagtcctataagtgaccacttatgtaggaggccccaccacacgagtccctaggtgtgactgtccagtgacaggcttatctctctgatgtggagggtgacggctctcgctcatggaacctgggaaaatcatggtgggaggagtcagaaactgatgggaggccaggtctggatgacagtggaggatggagtcagtgttagccccagatggacaaggccaggccctggagttgggaccctggttcccaggggaaacgagctctcctctctcccttctgggagtgaggaatgggctgactagggcatgacagaggctctccaggcttccctttgtgggattactggctgtgcgtcagagaccccttcctggggcctgtttcagagctggtgggtgatttccccttgtcatcctctcctagttgaggggctgtggggagaggtaggggggaccagagaaagcaaagtgtcatttccactcaattggggatttactgagtgacagacaccactgtaaacacttcacacatgtcaaattttcctagcaacctatgtgatgcggatgacattagggttagggttaggttagaggagaggaggcacccagaggttctcatgggctaacgaattccacagccagcctccaaccctggtgtcctgctcctgagccctgtttccaaaggactggggcctgttgccttcccgatgtttatcattgtcaaagacagagcccagggactgtgctgctgggtgactatacatccttcctcacttttttattttaaaaatcttttatttttcagggctgggttcagtggctcacgcctgtaatcccagcactttgggaggccgaggtgggaggatcattttgaggtccagagttcaggagcagcctggccaacatggtgaaaccctgtcactactaaaaatacaaaaattggccgggtgcagtggctcatgcctgtaatcctagctactcaggaggctaaggtgggaggatcacttgaacccaggatgtggaggttgcagtgagccgagatcgcaccactgcactccagcctgggtgacagaccgagactctgtctccaaaaaaaaaaaaaaagaaagaaagaaaacaaacatcacagagacatttactcacaaagtaaaccaacttctaacctagcaccccaaaataatcaagtttaaaagtttgcaaaaaaaaaaaaattgttctctagtctttcagatcatcttttccctcttgtacctgggagttggccttgtgagtttggaatcagaactcaggctattgccaggcacagtggctcaagcctgtaatccaagcactttgggaggctgaggcgggcagatcacctgaggtcgggaccagcctgaccaacatggtgaaaccccgtgtctagtaaaaatagaaaattagctgggcgtggtggcacatgtctgtaatcccagctactcaggaggctgaggcaggagaattgcttgaatccgggaggcggaggttgcaatgagctgagatcgtgccattgcactccagcctggcaacagagtgagactcggtctcaaaaaaaaaaaaaaaaaggtattgtttcagaacccaaaggtgaggactagagaaaggacttattattctgatttaaaataatacttttttttttttttttttttgagacaaagtctggctctgtcgcccaggctggggtgcagtgatgcaatctcatctcactgcaacctctgcttcagcctcccaagtagctggaactacaggcacatgccaccacacccggctatattttttgtagagatgaagtctcgtcatgttgcccaggctagtctcaaactcctgagcttaagcctcccaaagtgctaggaatacaggcgtgagccatggcacccagctctctttttttaatttctgtattttttttattttcttcttttttttcttaaaactgggtctcactctctcacccaggctggagtgcagtagcatgattacagctcatggcagcctcaacctcccaggctaaagcaatcttcccacttcagcctccagattaggtaggaccacaggcgcgtgtcactatgcccagcaaattttttcttttgagatggagtttcgctcttgttgcccaggctggagtgcaatggcatgatctcggctcaccacaacctctgccccctgggttcaagtgattctcctacctcagcctcctgattagctgggattacaggcatgtgccaccatgcctggctaattttgttttttttttttagtagagacggggtttttccatgttggtcaggctggtctcgaactcccagcctcaggtgatccacccacctcagcctcccaaagtgctgggattacaggcaagagccactgcacctggcccagctaattttttttatgtagagatgggctctcactgtgttgcctaggctggtctggaactcctgcgttcaagcaatcctcccacctcagcctcccaaaatgctgggactacaggcgtgagccacagcacctggcctgcatcttttttctcaactaaaacaaaacaaactaaaacaaaactaaaacaactaaaacaaaacaaactaaaacaaaacaaactaaaacaactaaaacaaaacaaactaaaacaaaacaaaacaaaaaaaccttacatttaagataattgtagattcacatgcaattgtaaaaaataatggggagagataagccagtttcccccagtggcaacttcttgcatagctatagtacactatatcacagcagaatattgaaactgctagaagcattggccttactgagatttcaccagtgttacatcactcatttgtgtgtgtatgtacgtttagttctgtgcaactttatcacctgtgatgcctgtgaccaccacagtcaagatctggaccagttcattaccaggatccctcatgctcctcttttatagccaaacccatttccctccctacttaggccccctaggcctaacctctggcaaccactaaactgtcctctatctctatagttttgttatttcgagaatgttaggaccgggcacggtggctcacacctgtaatcccaaaactttgggaagccgaggcaggtggatcatctaaggttaggggttcgagaccagcctgaccaacatggtgaaaccctgtctctactaaaaatacaaaattagccaggtgtgatggcaggcgcctataatcccagctactcgggaggctgaagcagatgaatcacttaaacccaagaggaagaggtgcactgcattccaacctgggcaatagagtgagactccgtctcaaaaaaaagaaaaaaaaagtgttaggctgggtgtggtggtgcatgcctgtagtcccagctacttaggatgaggcagttggatcacttgagagtttgaggctgcagtgagccgtgatcgcgatcatgccactgcactcgagcctgggtgacagagcaaggcccagtctcaaaaaaaaaaaaaaaaaaaaaaagagagagctatcatctcaccactgctctttagctctttagcatgggcaacagagtaagattccttttttttttttttttttttttagagacggagtctcgctctgtcaccaggctggagtgcagtggcatgatctcggctcactgcaccctccgcctcctgggttcaagaattctcctgcctcagcctcctgagtagctaggactacaggcgtgtgcccccacgcccagctaatttttgtaattttagtagagatgggatttcaccatgttggccaggatggtctggaactcctgacctcaggtgatccgcccgcctcgtcctcccaaagtgctgagattataggtgtgaaccaccgcgcccagcccaattcttttaaaaaaacaaaaactgataataaaactgagatgccttgagacttgatgcatctgtcagcacccaaatcatgagggtggtcttagtgcaggtgacttatctcccatactgctaagtacttgggggcagcttcttgaaaggtaactaggctgggcatggtggctcatgcctgtaatctcagcactttgggaggctgaggtgggcagatagcctgaggtcaggagtttgagaccagcctggccaacatggtgaaaccctgtctctactaaaaatatgaaaattagccaggtgtggtggtgggtgcctgtaatcccagctacttgggaggcggagacagaagaatcgcttgaacctgggagacggagattacggtgagctgagatcgcgccactgcactccagcctgggcaacagaacgagactccgtctcaaaaaaaaaaaaagaaagaaaaagaaaagaaaggtaactagccctctcctgcagaaaacgtggccttgattcagaacactcagagtttcagggtttggcctgagtgtttactgagacttatcagaggtgccacatgaaatcatttaggaacacaggtacctctttgatggggcctatgctgtcatttgtagcagatggcagaggagctggtggagtccttgcatccttctggtcacctgataattagcaggagtagtatttcctttttttttttgagacagggtctcactgtcatccaggctgaggtgcagtggtgcaatcttggctcactgcaacctccgccacctgggctcaagcgatcctcccacctcagcctcccaagtagctggcctacaggtgtgagccaccatgcccgagtaatttttgtattttttgtagagtcgagtgtcttgccatgttgcccaagctgctcaaactcctcagcttggccgggcacactggctcacacctgtaatcccagcactttgggaggccgaggtgggtggatcacctgaggtccagagttcaagaccaccctggccaacatggtaaaaccccatctctactaaaaatacaaaaattatctgggcgtggtgacacccacctgtaatcccagctactcaggaagctgaggcagaatcgcttgaactggggaggtggaggttgcaatgagccgagatcgcaccaccgcactctagcctgggtgagtgagactccgtctttaaaaaaaaacaaaaaaaaacaactcctcagctcaagcagtccacctgcctcagcctcccaaagtgctggcattacaggtgtgagccactgcgccaggcctcagggtattttcaagggtcaaagcagctttctccaaaatccaaaaactactacccaaaattatgcctctttcaacacccggcatttttagtgactcaagggatgaaaattcttatcaggcccttacttgcttacacattaaccactcgctttttgcccagtattccttgttcccataatgaaattatgaactgctgaaatactgttccttgtgaaggaggggataacttcagggccataaaaaaattttgcagaagtaatgaatgtctttaaacacactgcgaccagctgcagacacccagaagtctggttattcaagacactatgtgagactaaagaaacacagacttttcccccctcggttctctgaaactgcccctcccttagtctctagctgtgtaaaaactccccatgcctggcatggtggcttatgcctataatcccagcactttggaaggccgaggctgtagtgtactatgtcgattgggtatctgcagcaagttcggcctcgctatgacctcccaggagtggaggaccaccacgttgcctaaggaggggtgaactggcccaggttgaaaacggaggtcaaaacttccatgctgaggctgtgcgcggtggctcacgcttataaccccagcactttgagactctctcaaagtcactgcactccagcctgggtgatatagggagacccccatctctaaaaaaacaaaacaaacaaaaaaactccacgctgcttctttttgttaaggcagatttctcaccttggccaaatcaaataaacctttatctccaagcacctttgtcttggtgtttggcatcagctacacatcaggtacgcaagcctgaatttggggttctacaacataacaagatgcagtatcttgacttttaccttgcagggaatgccctagtcatgcccaaggccacaggttgaaaaacatttcctgtagtgtcagtaaatattttaggttttgtgggccatgtggtctctgatacaactacccatctctctgcctgctgtagtacctgggcagccatggacagtattaacaaatgggcacggctgtgtgtagcaacaaatgggcatggctgggtgccatggtgcatgcctgaaatcttagaactttgggaggctgaagaatacagatcacttgagctgaggagttcaagaccagtctgggcaacatagtgagaccccatctctacaaaaaatacagaaatcagccgggcatagcggtgtgcgcctccagtcccagctacttgagaggctgaggtgggaggataacttgagcacgggaggctgacactgcagtgagccaatatcatgccactagactccagcctgggcatcagagagagacttgtccctccccaacaaaagttaacaatcctggagcaaggggatgttttgctgtccatgttatgttgttaccttgggatgtcaggtcatctaacacattccctttcccatcccctggagccctttccacccatgcatcctaaatctagcatagacttccagggttgtgaaggtactctttgaatctccaccactctacgaaatctgaggtctcatcttcatggcattccagccccatttccagcggaaactccacctgtttctgtgggtctccctcacctacaggcctctccttccccatgcagtgctgacacttgaagcatggtaggcccatgggtgggcagagatcccagatcagggttacagcaaggacagttctccctaggtttcccccatgccagtcttccgagtgcctctttctgcgtccctgtaccctgccattcctggtgatgctgctgccctcacatcaggccatccaagcatgcagaacataagcatgcagaacactggaacgaagggctgtacctaaggtgagcctctgaagcccaatgaggctagaaaaggctgaagacttcacagacctaatttttaatgcagctctcaggggttttaccaagagcatttatttactctttaagatactaatgaagacccttaatattggtaaaatcataacatataggttacattatacagctagtgaagtgggaaaataaagttgaagaattcccaatggtagatagcatttttgcacagaatggttttaaataaactccacattttaaagtcctgatggtttgtatttagcataaggtttaaaatgatagtaatactgtatgctatatatagagctgcctgaatttcaacattgctgttgccaaggtagatagcaatttgaaaatgggtctcaagcttgataatgtgtatcctgtcataacctaattaacaaatgcgccctacagaaatcaggagcgtgaccaaaaaaaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccacaaggaagtcttgtgcaactctcaggcgcctgcagccacgtgagcgcgcggctttcattttactcaggtattattactattattacttcttttgagacaaggtctcatttccgtcgcccggctggaatgcagtggcacaatcactgtcactgcagcctcgacctcagagcaagcgaccctcccgcctcagcctcccgagtagctgggacaacaggcgcgcgccaccacacgtggctaatttttttttctttacttttcagtagagacagtctatgttgcccaggcttgtcgggaactcctgggctcaagagatcctcccggctgggcctcccactgcgccaggcctgttctcactttcagagccctccggcagtcgccagctccccgccagggggccggactaacgcacccggccgtccgtgccttccccgcgctttcctgactccaaaatctcagcccgcggtgctcaccgcgtgggaccactgtctgggcgtgcggctctcgacctccgacgctgcgtctcccgatcccagtgggtccagttcttgccggtcccacgtacgggcccctcgacctcgaatcccgtcacccaaatctcagcgccacggcccctcattatgtgcagtcctcgctcggtcccaggtttgcggcgcttaaactcagatcgctcttccctgatcccaaatcccagccccagcccaacgatccccaccccaataggcccagtccccaggtagtccgggtacggggccctggacttcggatagtctccctaatctcaaatcccaccccccgtccccacccccagggggacccggtccccgctaggtcccgggtgtgcggccttcgacctcggagacttcggccgcccctcacctcggcctccgagtctctacactcccgctctcatatcaggcaccccggtggtcccttggagcacctagaggagggtgggacgcggggaacttggcagttgtagcagaggcagttgaggcttgttgaccatcaccatggaaacccccgcctgcgagcacggggcggagcctacgaggggcggggtcaggcgcgctgccggccccaatcctcagcgcctgcccgtcgagcgcacgcggctttgccggaagccctcctgctcccggcgagccaggccccgactaggccctactgcccggctcagccctttgccctggacaccaggaaacagaagcccaaggagcccgcgtccccaccccctgctacctgccggcgtgacagcgattcggtggccccccgaaccccaccttgaggaagacgcggcgcagtcctgcttccacgacggagccggaaggacgcaaggaccgcggcagggcggagtttctgcgtccggcgtccgggggcggggccgcgacggcgcattgtgacgcgccagagctgagccgccggttggccggctgggcgcggagcagagccgacacggctggcgggggaggcggtggaggcggacaagcgaggacgtttctggagaggagaagggaggggaggggaggggatagggggagggggaggaggaggagggagtggagcggcgggaaagatccctctgactgcccctgaggccctggaggaaggacactggtgagccccgcaggacactgaaatgtgcgccgaaaggacgcctgatggaagactaggatgggaaaaggaaatgagagccgatggcagggcgtggtggcgcaagcctgtggtcccagtaatttgggaggctaaggcgggagaatcgcttgagcccgggaggtcgaggctgcagtgatccgtgactgctccattgcgtccagcctgggcgacagagcgaggcgctgtctcaaaaaataaaataaggaaagtagtacactgaaggccgggcgcggtggctcacgcctgtaatcccaccactttgggaggccgaggcggacggatcaggcggtcgggaaatcgagaccatcctggccaacatagtgaaacccctactaaaatacaaaaaaattagccaggcgtggtggcgcgcgcttgtagtcccagccactcgggtggctgaggcaggggaatcgcttgaacccgggaggcggagcttgcgtgagccgagatcgcgccactgcactccagcctagcgacagagcgagactacgtctcaaagaaaaaaaaaaaaaaaaggtacactgagtactccggagaccgcctaaaggggtctcagagcagggcgttaggagggatttgtcaggttgaagttgctcaggtgataaattccgtggtgtgagaagcccccaaacctcagaatgtaactcagacccaggtcgagggcaagattttcagtcacagagcacctgaacacacagatttggtggctaatggctaagccagggacagattttctttcttttctttttttttttgatgtattgtagggctaataattgtaaccattttattttggtggatcttcttcatgaagagatgatgtcaaggcactcatcacaggttaagctgaacattgttactattgttattatttccagactgagtatcgccctgtcattcaggcgggagtgcagtggtacaatcacggctcactgcagcctcgacctcctgggctcaagcgatcctcctgcctcaacctcctgagtagcaccaccactctcggctaaattttgtattttttgtagaggcgaggtttcgctgtgttgcccgggctggtcgggaactcctggactcaagccatccgcccacctacgcctcccagagtgttgggattactggattgagccacgcatctggctgaacgttattttttaaatcaccagagaaagtaaaggagtgctcaaaatagtgtcagatgatgagtgggatgattgtgatgaaggaaggagtttgttaaaagaaaaagctagttccaagaaagagaatggaaagagtaaagcaggagctgtcagaataggtaaaaatgtccaaagagaaaactgcataatttgaggcaaaattacagaaaatagttcctgcaaaaatcagataggtattcagcatcataggaaaggggcgaaaatcagataggtaggtattcttaagaagttgtggccggccgggcgcggtggctcgcgcctgtaatcccaagactttgggaggccgaggtgggtggatcacctgaggttaggcgtttgagaccagcctgggcaacatggcgaaaccctgtctctactaaaaatacaaaaaaaaattagccgggcgtgttggcgcgtacctgtagtcccatctaccctggaggctgaggcaggagaatcgcttgaatccaggaggtgatggttgcagtgagccgagattgcaccattgccctccagcctgggtaacaagagcgaaactctgtctcaaaaaaaaaaaaaaagtcatacagtgactgcatcacagctcatgctgtagaaagatgtttctggagagaaaaattcaagtagccaatttaaatcgaatattaggaaaattaaaccaaaagggctcacgcctgtaatcctagcactttgggaagccgagtcaggcggattacctgaggtcaggagttcaagaccatcctggccaacatggtgaaaccctgtctctactaaaaatacaaaaattagccgggcgtggtggcacatgcctgtaatctcagctactcaggagggtgaggcaggagaattgcttgagcccaggagatggaggttgcagtgagccaagattttgccactgcactctagcctggccgacagagcaagactctgtctcaaaaaaaaaaaaagaaagaaaattaaaccaaaagactagtaatgcttcagaaattagggactgttaaaccagctgcaagaagatatattcatgcaatctttgtattaagagtctctctggctgggtgcggtgactcagacctgtaatcccagcactttgggaggccaaggccagtggattgcttgagccctggagttcaagaccagcctggggaacatagtgagacccagtctgtattttaaaagttaaaaaaaaaaaaaagcctctaagctaagtggacctttgatcccctcactcaaatttgacagttctccattattcataaatgaggtaatagttgttggagacggtcttctctgaatgcaagactagtactttggcctgattatagaacttcctgccgtcctaaggagtcatcccaggtgtccactatatctttttcagcattgagtaccagcacagtcacatgtaggctttatcccacagtgaagacttggcatcactcagaatgatgccacaggtcctaggccttttccacactgggctcacttcaccaactcgcaaatgctcatccacacctggtccacctggactacctccttatctgtagccctttcacctctgtgtccatagaaatgtcttacctaagctctgaaatctaaacattcagagagcaccttgatgcttgagagcatctacacagagatgaacctttaagatctatggtttaaaacaattgaattccaagatgttgccccttacagactgacctgcctgattatttcctgttgtttatgtacattgattattatcaaaaacttaatactttattttttttgagacggagtctcgctctgtcgcccaggctggagtgcagtggtgcgatctcagctcactgcaagcttctcctcccgggttcacgccatgctcctgcctcagcctcccgagtagctgggactacaggcgcccaccacggcgcctggcaaatttttttttatttttagcagagacaggttttcaccgtgttagccaggatggtgtcaatctcctgacctcgtgatccgcccgcctcggcctcccaaagtgctgggattacaggcgtgagccaccgcgcccagccaaaaacttaatagtttttaataaatattgtcaggtttttttttttttttttttttgagacggagttttgctcttgtcacccaggctggaatgcaatggcacgatcttggctcaccgcaccctccacctcccaggttcaagcgattctcctgcctcagcctcccgagtagctgggattagaggtgcccaccaccaggcccggctaatttttgtatttttagtagacacggggtttcgccttgttggccaggctagccttgaactcctgacctcatgatccacccgcctccgcctctcaaagtgctgggattacaggcgtgagccaccgcgcctggccaatattgtcagttttaaaaaataagttcccctctagacactacttatccatacaattggttacaggtttggagcgttacagaggtttttaaatcttctactcagtagttcttgaaaaatcaccttacctattaagctgagattcccccttcccgcaagacggtgccattaagtaggcagggatcaccaaggttcagagatgtctcttgctcaaaaatcatagtatctgttaaatagcaataaccgtagctaacacatactgcattctcactatgctttgtgctattctacttaatcccactgaaacctggtaacaaccctgcagtagatactaccaccatttggcggaaagaaactgagtcacccagcttctagatggctgagctggaagttgtatggaggctggaggccccatctgattccagggtccgttctcaactactgcaatctagatcctagcgagaaacgggcttttcaggctgtctcctccctttcccatctgagaggagaatgaaggaagtgagaaagccaactgacctgtctagtcagtataggccctgtctaaatgtcacttttctccttgaagcgaggtgctctaggaggcagagataacccaggtgggaagaggcacattcggcagtgacagccttgtctggttaattttcatgaccaatatagaaaagtgcaactttgaggccgggcacggtggctcacgcctgtaatcccagcacttcgggaggccgaggccggcgaatcacgaggtcaggagattgagaccatcctggctaacacggtgaaaccgtgtctctactaaaaatacaaaaaattagccaggtgaggtggcgggtgcctgtagtcccagctactcgggaggctgaggcaggagcatggcgtgaacccgggaggcggaacttgcagtgagccgagatggcgccactgcactccagcctgggcgacagcgagactccgtctcaaaaaaaaaaaaaaaagaaagaaagaaaagtgcaactttgaagctgctctgatactcactgaagtgagctaccaccaggaaggctggatccctaggttatttgcaattctttcagagaacttgacagttctttcaaatagcactttttactgtgtattaaatagtgaaagaaggattatgggatacctgagcttgctggttacttgcttgaattggtttctttgcccaataaaggaccacagcttgattaggtggtagtggccagtgttggtggagtggctgcccttactttgcccatttccccagcaggccaagcaagcaactgagggactcacttggatgttagtaagctaagttctagctctttcttcacccttttattttatttttttgaggcggagtctcaccctgtcgcccaggctagagtgcagtggcacgatctgggctcactgcaaactctgcctgccaggttcaagcaatttttggataatttttgtatttttatttatttacttttattttatttatttatttttgagacggagtttccctcttctaccccaggctggagtacaatggtgtgatctgggctcactgcaacctcctcctcctgggttcaagcgattcttttgcctcagcctcctgagcagctgagatcacaggcacccaccaccatgcccagctaaagtttttttttttttggtatttttaatagagatggggtttcgccatgttggccagggttgtttcgaactcctgacctcaggtgatccgcctgcctcggcctccaaagcgctgggattacaggcatgagctactgcgcccagccaatttttgtatttttagtagggacaggttttcaccatgttggccatactggtctggaactcccgacctcaagtgatctgcctgccttggcctcccaaagtgctgggattataggcaggcatgagccaccacacctggccagctcttttttcattctaagtcatcatcttttagtctgatcatgagttttcctaccaaaaactgtgtacagttagatgccttcagctctatggagcctcagaagagtcagaaaacttcatttggatcaaaatgtgcaagggacaggacagcatgcaccttctctttctctctgcctttctttttctcctattaacttacatttaaaaaaaaattatggaatatttgaaacatacagaaaattatagatatataacaaatttaacagacattttgctcttttattgtttttggacaaaagataacagataggccaggtgtggtggctcacacctgtaatcccagcactttgggaggccgaggcgggcagatcacaagttcaggagttcgagaacagcctggccaacatggtgaaaccccatctctacaaaaaatacaaaaattagccaggtgtggtggcatgtgcctgtgcctgtaatcctagctttcgggagactgagggagaagaatcacttgaaccggggaggtggaggttgcagtgagattgtactccagcctgggcaacagagcaagactgtctcaaaaaaaaaaaaaaaaaaaaagattatagataaaccagtgctctgaggtgcttttcggctctttaaaaagcattactgggccaggcgcggtggctcatgcttgtaatctcagtgcttttgcaggctgaggtgggcgggatcacctgaggtcagaagttcgagataagcctaaccaacacggagaaaccatgtctgtactaaaaatacagaattaggcgggcgtggtagcacatgcctgtaatcccagctacttgagaggctgagacaggagaatcacttgaacccgggaggtggaggttgtgctgagtggagatcacaccactgccctccagcctgggaaacaagagcgaaactccatctcaaaaaaaaaaaaaaaaaaaaaattgcgaggcgcggtagctcacgcctgtaatcccaacactttgggaggccaaggcgggcggatcaccagagatcgggagttcgagaccagcctgaccaacatggagaaaccccgtctctactaaaaatacaaaattaaccaggcatggtggcacatgcctgtaatcccagctactagggaggctgaggcaggagaatcgcttgaacccaggaggcgcaggttgcggtgagccgagatcgtgccattgcactccagcctgggcaagaagagtgaaactctcaaacaaaaaaaaaagcattactggccaggcgtcgcagcggctcatgcctgtaatcccaacactttggaaggccgaggctggcggatcacaaggacaggtgttggagaccagcctgaccaacatggtgaaaccggtctctactaaaaatagaaaaattagctgggcgtggtggtggacgcctgtaatcccagctactcagggggctgaggcaggagaatcgcttgaacccgggaggcggagtttgcagtgagccgagattgagccactgcacactccagcctgggcaacaagagcgagactcagtctcagaaaaaataaataaataataaaataaaaagcaggccgggtgcgatggttcacacctataacaccagcactttgggaggccgaggtgggcggatcacgaggtcaggaattcgccaccagcctggccaacatggtgaaaccccgtctctactataaatacaaaaattagtggctgggggcagtggctcatgcctgtaatcccagcactttgagaggctgaggcgggaggatcacgaaatcaggagatcgagaccatcctggctaacacagtgaaaccccgtctctactaaaaatacaaaaaaaaaaaaaaaaattagccgggcgcagtggcaggcgcctgtagtcccagctactcaggaggctgaggcaggagaatggcgtgaacccgggaggcggagcttgcggtgagccaagatcgcaccactgctctccagcctgggtgacacagcgagactccgtctcaaaaaaaaaaaaaaaaattaggcgtggtggtgcgcgtctgtaatcccagctactccagaggttgaggcaggagaatcgcttaaacccgggaggcggaggtcacagtgagccgagatcatgccactgcactccagcctgggcgacagagcaagattctgtctcgaataataaataaataaaaattaaaaagcattactgtaaatatatttttttactttggtaactcaaaccattcagcctgtgtcctctccctctcattcccccacggaggagaagaaacctcaatggcgaaagcaacaccaagcgccggcttcacactcaggagaaaactgcacctcctgtcgtttccgggggctctacactttcacagaaagtactctagtagcagactatagaaatgatccctgaaagccgcctaatttttgaatgataaaatatttctaaattggtcaggcacagtggctcatgcctgtaatcccagcactttgggaggctgaggagggtgaatcacctaaggtcaggagtttgagaccagcctggccaacatgacgaaaccccttctctactaaaaatacaggccgggtgcggtggctcacgcctgtaatcccagcactatgggaggcttgaggcaggtggatcacctgaggttaggagatcaagaccagcctggccaacatagtgaaacccggtgtctactaaaaatagaaaaatcagctgggcgtggtggcacacatctgtaatcccacctactcgggaggctgaggcagaagaattgcttgaacccagaaggtggagtttgcagtgagccgagatggctctactgcactccagcctgagccacagagcgagactccttctcaaaaaaaaaaaaaaaaaaaaaaacaacaaaaaacctgaagataactttatatagtcagtggggagtattgaagtttcaggatcagagatttaataaaatttgtggccctttaggtaaatatctttaaagaatattgtttcaggcaacgtagtttgtgtgtgggtgtgtgctgtcttgacttagattttaggctctggctaaaagccagttagttcctcttcttgagctgccgattatgtctgcacccccaaccacctctgttatcaggctcaaacactcgggaccattatacaccgtaatcactccagggccagttaccagacaactagggccagccccatgcccctgagcccccggaaattactcaaattagccaatcccaaacctgttggccttgcctaacccttctcttcctgcaaaaaccacaacaaaggctcttctgcagttcccccctcactccctctgcctagtgaccccttctgctcctgctgagtggccttgtgtgaagccccagggaaatgagagtacaaaactaaaacttgggccaacgtggtggctcacgcttgtaatcccagcactttgggaggcagaagcaggcaatcacttgaggccaagagttcaagaccagcctggccaacatggtgaaaccctggctctactaaaaatacaaaaattagctgggcatagtggcgcgcacgcctgtagtcccaggtactcgggaggctgaggagggagaatcgcttgaaaccgggaggtggaggagcaacctcctctgggaggctggagctccactactctccagcctgggtgacggagtaaaagactgtctcaaacaaaaaacaaaaacaaaaactgtaaaactggtttgtaactcctgtgctgcatctaatctcaccatacctcacccaaggtaaactgttttgtttgtgtttttgtgtttgagacagagtctggctctgttacccaggctggagtgcagtggctcgatcttggctcactgcagcctccacctcctagatttaagcaattctcccgcctcaatctcccaagtagctaggattacaagcatgtgccaccaagcccaactaatccttgtattgttagtaaagatggggttccaccattggttggccaggctggtctcaaactcctgacctcaagtgatccacctgcctcagacccccaaagtgctgggattacaggcatgagccaccgtgcctggccaaatctgagctttttataaaatcttcatcataatggttcttaataatgttgactttgaagttttcttccctccaacaacagagagtggggaaaaaagatagttcataaagatcagttgatctttttaaaataattttttttaagacagagtcttgctgtattgcccaggctggagtgcagtggcacgatctcagctcactgcaagctccgccttcaggggtcacgccattctcctgcctcagcctcccgagtggctgggattataggcgcccaccaccacgctcggctaattttttgtatttttagtagagacggggtttcaccgtgttggccaggatggtctcgatctcctgacctcgtgatccgcccacctcagcctcccaaagtgctgggattacaggcgtgagccactgcacctggcctaaaataatttttaattgacaaataattgtacatattcatggggtacatagtgatgttttgatacatataacgtatagtgatcaggataattaacatccatcatctcaaatatttatcatttcttcctgttgggaacattcaatatttttctcctagctatttgaaactattatggtgaaccaaagtcatcctatggcatagaaaaccagatagctgtacttatgtatatcctttagcaaatctctccttatccttcctttccccctaccattccccttttaaatttttttttttttactttttggagacagggtctcactttttcgcccgggctggagtgcaatggcgcgcagtctggtctcactacaacctctgcctcctgagctcaagcgatcctctcatctctgcctccagagtagctgggaccacaggctctcgccagcacgccccgctaatatttgtatttttctttttatagagacgcgtctcgctatgttgcccaggctgatcttgaactcctgggctcaagcaatccgtctgtctccgttttccaaagtgctgggatcacaggagtgtgctaccgcgcccagccttgtttttttaaattattttttgttgaagggtcttgctgtatagcccaggatggagtgcagtggtgcgatcccggctcactgcagcctcgacctcccgggctcaagcgatctctccgtcctcagcctcccaagtagctgggaccacaggcgcgtgccaccaccgtgctcagctccttcccagtttaactgtggttaaaactggtgtgtgaaggcaatgagagagacccgcgaaaaatgagaaacaagggttagggctgacgtcttttgcggacaaagaaaaagaaaccaaagtttcctcagaaaacttaagttgcctcacagccgcctggtatcaggaaacactgagcccgcccaacgcgggatcctccaggggcaggccgcctgaggcccacccggagcaggcggggcggccgcaggaccacgtggcccagagcgcccttccagcgctgccggcggcggggcgggtgccgggcgcgcctgctgcgcggggcgggacgcggactcccaggctctgcggagagcggctgccactcgcctctgtttttttcttgagacctagtctggctctgtggctcaggctggagtgcagtggcgtgatcaccgctcactgcagcctcagcctcctctcgcctcagccgctcggtagctgggaccaccagcgggcgccaccactcccggctacatttttttgtatttttagtagagacgtgggtctcgccatgttggctaggctgctgccgaactccggggctcaagcgatccgcccgcctgggcctcccaaagtgctgagactgcaggcatgagccaccgcgcccggccgagagcctcttttggctcctcctttcgcctttccggggccaggcgtgtgcagctctgtgaagggtcccctccctctgcgggacgtcctcgctgccgaggtcagaggtgcggagaacatgagacccgaggtgcgttccagcatgttcctgcagccctccactcccgcggttgcgtaactcagatccctgaaacacatcgcacatacacgtgactggtggtttctctctttaaccctgatagatacaggagtccactaacagagataaggaattgtaccatgtactccatgcttcaataactgggtgcttagagacaagcctgagttcttactgccatcctaacacccgcagcagaggttaacctactatcggacaagtggtcaacttttctgccttcgggaagacttggggctgggctgagagagataatctagaacttttatagtgatcccgtgtacatttccctagaatgatggattagggtatagtgattaaatatataatgtatactttaatatacattaaaaagttctggaaggatgtacttcaaaatgttatcagtggtttcttccatttttcccgtttggaatattggaacaaccgactatgttattttagccctttctccttccttcattgcttctccaaattcaggggcctcattggagcaaacttgtttgcaggtcatctgggcaccctcttgaaataaatcgtctctctttgctcttacaggtctcaactgcttcttaccaatattaattccagtgactactatcagaatatgatgagcaatccactcatcagagaagctgtttctacactctcctgaatgaccattttatagatgctgggaaaaaattgtattaaagactatgagttagctgggcttggtggctcacgcctgtaatcccagcactttgtgaagccaaggcgggagcatcgattgagcctagcagttcaagaccaaccttggcggcataagcgagaccctgtctctacaaaaattttaaaattagccaggtgtggtggtgtgcacctataatcttagctacttgggaagctgaggtgggaggattactcagcctaggaggttgaggttacagtgagctgggatcacaccactgcccttcagcctgggtgacagagcaggaccccgtctcttaaaaaaaaaaaaaaaagtggtggactttgttatccttatgcatatgactcatcaatatatctgtatttccatatagaaagaacacttagaccgggcacagtgactcacgcctgtaatcccagcactttgggaggccaaggctggcggatcacttgaggccaggagttccagaccagcctggctaacatggcaaaaccctgtctctactaaaaaatacaaaaattagcctggtatggtggcacacgcctgtaatccctgctactccggaggctgaggaatgagaatagtttgaacctgggaggtggaggtggcagtgaatcaagattgcttcactgcactccagcctgggcgacagagtgagactccatttcaagaaatagataactaaataaataaaataaaagagaacacttagaaaggaacatgctatagcaaactaaaattatagatgtcaaaaatttaatctggattacccagcatctcctataagaaacaaaggggccctctccctctccctctccctctccctctccctctccctccccctccctctccctctccctctccctctccctctgatgccgagccaaggctggacggtactgctgccatctcggctcactgcaacctccctgcctgattctcctgcctcagcctgccgagtgcctgcgattgcaggcgcgcaccgccacgcctgactggttttcgtttttttttggtggagacggggtttcgctgtgttggccgggctggtctccagctcctagccgcgagtgatccgccagcctcggcctcccgaggtgccgggattgcagatggagtctcgttcactcagtgctcaatggtgcccaggctggagtgcagtggcgtgatctcggctcgctgcaaccacctcccagccgcctgccttggcctcccggagagccgagattgcagcctctgcccggccgccaccccgtctgggaagtgaggagcgtctctgcttggccacccatcgtctgggatgtgaggagcccctctgcctggctgcccagtctggcatccaggcagactggattaggcagtggttaagagtcatcaccactccctaatcttaagtacccagggacacaaacactgcggaaggccaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaataaattaattaaaaaaaaaaatttaatctgttatttgttactggaatatgttcattcttgcacttgggactagagttaagagtattttagaaattgcaaaccaaataatgaagctcccatgtagatctgactcagaaaaacacagaacactgtgcggaacaccatcccttttctcaccttatacccctattctacctcctccatccctggaaacaaggcaacagtcctcttttgtagttacacagtaccttgctttagacattctaactgccttcatcctctcaaaactagataatttaggtaagacttaagaagtttcagactgctggccggacacggtggctcatgcctgtaatcccagcactttgggaggccaaggtgggcggatcacctgaggttgggagttcatagaccagcctgaccaacatggagaaaccctgtctctactgaaaatacaaaaattagctgggcgtaggaaatgtatatatttccataaagtattgagtcttctgtttaatcacatcagtaggaatctaaaagcaattttggatttttttttttttttttgagatggagtcttgttctgtcacccaggctggtgtgctatggtgcaatctcagctcactgcaacctccgcctcccgggttcaagtgattctcctgcctcagcctcgtgagtagctgggactacaggtgcgtgccatcacgcccagctaatttttgtattttcagtagggatggggtttcaccatgttggccaggatggtctttatctcttgacctcacgatccgcctgccttggcctcccaaagtgctgggattacagacatgagcaccgcacctggctaattttggaattttttacaaaaaaactagattttgtttctgctgccacaaatattaattattcctactcaaaagcctggcagctgtctgcccactgctgtgtagaacatatttatgtgatcactacttcgcatggtaactctgagagatgggtggttttatctctcggagggacttgtccaatgtcatagaaatacattatacagccagacttgattgtacaaggcccagatatgcatggatttcgcttaccatggttttgttaagtaacatcagtctcccaacaacagggttcaaatatcagttactacagtatgttaagtatgagcaattacataaaatataaacttcgttgccagctcgtcagtgcacaaagcactgtgaataacaaatgtacatgatcagtgacaagttgcgtaatttctttgaaagtctgttatttcgttcactcatgcacagaaaggcatgtggttgtgttgcttcttgtctcccaccataccgggcctcttggtaggtttttacaaagaaaactaattctcaatatttctttctttctcttttcttttcttttttttattgttgttgttgggggatggagtctcactctgtcacccaggctggagtgcaatagtgtaatctcagctcactgcaaactccgcctcccggttccaagtgattctcctgtctcagcctcccaagtagctgagactacaggcgcccaccaccacacctggctaatttttgtatttttagtagagacagggtttcaccatgttgaccaggctggtctcaaactcctgacctcaggtgatttgcccaacttggcctcccaaagtgctgggattgtaagtgtgagccactgcgcctggcctcaatatttctaatgtattaaattacatagtaccagataaatattagttttactattttcatttccctgtacatttcaaactgaaagagtttttaatgttttggcaaaaaattttgaaagtcacagaacaatcataatttttctcattgatcattaagattgctttgcatggtatcagcttgtatgctcacttttacagtcttacactactttgtacttatggtatggtacttatagtactttttactgggcaaagcaaggagacacacacatgcatacacacatagcaaataaatcagtctggcttgagaggaagatggttagaataggactcaggcacagtgggtttctgtgcagctattcaccatttaggcaacttttccaaagttgcttagcttagcttccctgggataagttttctggacagcaaaataatgggtctttttttttttttgagacagagtctcgctctgtcgcccaggctggagtgcagtggcaccatctcggctcactgcaagctccgcctcctgggttcacaccattctcctgcctcagcctcctgagtagctgggactacaggcgcccgccaccacgcccagctaattttttgtatttttagtagagatgaggtttcaccctgttagccaggatggtctcaatcacctgacctcgagatctgcccacctcagcctcccaaagtgctgggattacaggcgtgagccaccgcgcccagctataacgggtcttaactgggactctttctcttctatcccagccagtctcacttctgccagccaggcctaactttcatcccttaagagagagagggccacttgattcaatatacaacgaagtaatgaatactgaatctataagtaagtctaccgatatctgtaaaagcagtgaaaagcaatttggtttcctaaaaatgttaactataaatattatttcctatcagtttgctgatttcctgtaagttggctgacttagccacaaagttagttttcattcatcttgaccacacctgacaggtctgtttccatggctgggatcctctccccatggttctttctggtgctgaaatgcacttgggcaaccatgccccttaaatgtgcctttatgggttagatgtggtggctcatgtctgtaattccagcactttgggaggctaaagcaggagaattacttgaggtcagctggagaccagcctgggcaacatagtgagacccccctccccctcaatctctttaaaaaaatgtttttggccggacacggtgactcatgcctataatcccagcactttgggaggccgaggcagatggatcacctgaggttgggagtttgagaccagcctggccaacatggaaaaacccccgactctactaaaaatacaagattagccaggtgtggtggcgcttgcctgtaatcccagctactcagcaggctgaggcaggggaatcgcttgaacccaggagacagaggttgcagtgagccgagatggcgccattgcactccagcatgggcaacctgagtgagaccctgcctcaaaaaaaaacaaaaaaaaaaacaaaaaaaaacggccagtcatggtggcttacgcctgtaatctcaccactttgggaggccaaggcgggtggatcacctgaggtcaggagtttaagactagcctaaccaacatggtgaaactctgtctctactaaaaatacaaaaattagccgggtgtggtggcgggcgcctgtaatcccagctacttgggaggctgaggcaaaagaatcgcttgaacccgggaggtggaggaggttgcagtgagctgagatcatgccattgcactccagcctggacggcagcctgagactatctcaaaaaaaaaaaaaagaaaaaaaaaaagaaaaagaaaatacatgtaggccgggcatggtggctgacgcctgtaatcccagcattttgggaggccgacgtgggcctatcacttgaattcagtagtttgaaaccagcctggccaaccaatagtgaaaccctgtctctaataaaaatttaaaaataagccaggcatggtggtgcgtgcctggagtcccagttacttgggaggctgaggcaggagaatcactagaacccagcagggaggctgagggagcagaatcactagaatccaggaggcggaggttgcagtgggctgaaatcacaccactgcactccagcttgggtgacagaggagactgtctcaaaaaaaaaaaaaaaaaagaaaccaaaaccaaaaaaaccacaaaatacatgtgaacatgtgctcacttcagcagcatatatagtaagattaaaatgcacatgaactcttacggaaaaaatatttctagtagtcagcaaatactgaaaatttattgagctctgtgcctgatggtatagaagttaagaagaattaaactgttctgtccttgcttttatttattttttaacgtgttggataccagcatccttgctttttttttttttgagacagagtctcgctctatcgcccgggctggagtgcagtggtgcgatgttggctcattgcaacctccgcctcctgggttcacgtgattcttctgactcagcctcctgagtagctgggattacaggcatgcaccaccatgaccagataattttttatatttttagtagagacaggggttcaccatgctggccaggctggtctcaaactcctgacctcgtgatctgcccgcctcggccttccaaagtgctgggattacaggcgtgagccaccgcgcctggccagcatccttgctttttagagcgcttactgccaagctgagggataagtcagatattatacgttttcagaaaagaagacacatgcaggagctgcatgtaattggaaacaaacagaatatttgagaattgaaaagtttgattaaatcacacagcaatgaaatataaagactaatataaaaatagcacatttccaatcaatccttatctgaaataaatgtatattgtgcacctgttaggaaccctatactgtactaaaaactaaattaaaaccaaccacattaagcccttgaagcaaagtcagagcaaaccctcctgaagcctatggagcagcgctccttcaccctccgtttcagatatcaagtccctgtgctgttcataaatgagacaaccttacaataagctgctttcaattcatagacattgggtcagtgcctttggtgtgaagtcatccatgttagggtacaatttcatgagtcgacaaacggagttagagtaagctccctatgcctccattctgagaaattttgcatccacagagtaaaagtcgatggatagcatattaggaggctgcatttttcttctatactttttttttttttagacagagtctcactctgttgcctagcctggagtgcagtgacgcaatgttggatcactgtaacctctgccttctgggttcaagcgattctactgccgcagcctcctgagtagctgggattataggcatgtgccaccacgcctggctaatttttgtatttttagtaaagttggggttttaccatgttggccaggctggtctcgaactcctgacctcaagtgatccactcacctcagcctcccagaatgttgggattacaggcatgagccactgcgcccggcctcttctatacatattagtaaaactcccacagcatactgcagcatattgtgaaataacagaataataagcaaggcttgtcagataaaggggttccaacccttcagggtaagtcaagaaaggcagtaccttagcatacagactgagcaacaggtcaggtttaagataggacttccattgttctgtctcagactagagctcattgtatgatacaggggccatttagccatgaaaagttgttgagcacctgaaatgtggttagtttggccaggcgcggtggctcacgtctataatcccagcactttgggaggccaaggctggcggatgacgtgatcaggtgatcgagaccatcctggctaacatggtgaaaccatgtctctactaaaaatacaaaaaattagccaggcgtggtgtcacgcacctgtagtcccagctactcgggaggctgaggccggagaatcacttgaacccgggaggcagcggttgcagtgagccgagatcgcaccactgcactccagcctgggtgaaagagcgagattctgtcgcgaaaaaaaaaagaaatgtggttagtgccactgagaggctgactttttattttattgtattgtattattttttgagccagggtcttgctttgtctgtaatcccagcactttggaaggctggggtgggtggatcacctgaggttgggagttcgagaccagcttggtcaacatggtgaaaccccgtctctattacaaatacaaaaatgagccaggtgtggtggcatgcgcctgtaatcccaactactagggagcctgaggcaggagaactgcttgaacccaggaggcagcggttgcagtgagccaagatggtgccactgcactccagcctgggcaacacagcaagactccgtctcagaaagaaaaacaacaataaactccactgtatgtatataccacattttgttcatccattcatctaaccagtggacacttgactcacctctatcttttgactattgtaaataatgctgctatgaagatgaacatacaatatctgagtttctgctttgaattcttttgcatatatacccaaaagtggtactgctggatcgtatgtatggtaattctgtttcctgaggatctgccagaactcttttccatagtgctgcaccattttacatttctatcaacagtacatagagctgacatttcttcatgtccttgccttaaatttaaaaacaaatactcattcagttattagaagacttttttttttccttttgagacaagagttttgctcttgttgcccaggctggagtgcaatggcatgatctcggctcactgcaacctctgcctcatgggttcaagtgattctcctgcctcagcttccttagtagctgggattacaggtgcccaccaccacgcccagctaatttttttgtatttttaatagagacagggtttcactatgttggccaggctggtctcgaactcctgatctcaggcaatccacccgcctcggcctcccaaagtgctgggattacaggcatgagccactgcgcccggcctagaagacttttaagtatgtttagaacaacttgggtatgtgaatctactttttcaactattattttattttatttttgagacagagtgttgctttgtcgccaggctggagtgcagtggcctgatctcggctcactgcaatctccacctccaaggttcaagcgattatcctgcctcaccttcctgagtagctgggactgcaggcacccaccaccatgtccagctaatttttgtatttttagtagagacggggtttcaccatattggccaggaaggtctcgatctcttgacctcgtgatctgcccgcttcggcctcccaaagtgctgggattacaggcttgagccactgcacccagcgtcaactattatttttatggattctaaataaaaattaagtatacccaggaagatatagcatatgcattgagatgtgctgtaataccaggtttcaaagacaatacagaaaaaaagaatgtcaaatgtctcatggataactttattaatcacatgtgaaatataatagtttggatatattgaatcaaataaaatattaacattaatttcacccgtttctttttacttttataaatgcagctagtagcaatttttttttttttttgagacagagtcctgctctgtcgcccaggctagagtgcagtggcgcggtctcggctcaccacaacctccgcctcctgggttcaagcaattctcctgccccagcctacggagtagctgggattacaggcatgcgccaccatgcctggctaattttatatttttagtagagacagggtttctccatgtcagtcaggctagtcttgaactcctgacctcagaggatccacccacctctgcctcctacagtgctgggattacaggcgtgaaccactgtgcctggctggcttatgtatttctatattctattctacagcactgctacagaggtagcctccactcataccacataattatgaaagccatcagattctggaagacagactccaagctgcaattgctgtaagtcaagtaatccctcttctccctcttttctgcccttaacatgcacatttattttccttttattattggattccctgaatggaaacatctgtccactattactgcagaaggctgggctgtcccatggtgactgtctggtgtccaggcttgagtaccctattttctgttttgttggttgtcctgtacagtgttgattaatttctgtgtctggggaagtctaggagtaggggatggggctgggtgatgctgacaacaccaagaaaagctcaggagatgtgtcaatgtgtttgcagagtctaaagagataccttccttccttctcttttgatttgacaatgccgccttaccaaaacttttcctgttcctcctgcagatttgtgggttttattttttatagagacagggtcccactgtgttgcccaggctggtctcaaactcctgggcttaattgatcctcctgcctcagcctcccaaagtgctaggattataggtgtaagccaccacactcagccacatttggggttttaaatttaattttatatttattttaattaattattttgagatagagtcttactctgttgcccaggctgtagtgcagtggcatgatcatggctcactgtagcctcaacgtcctgggctcaggtgatctttccacctcagcctcctgagtagctgggaccaccagcacttgctaccacacctagctaatttttttgtatgttttctgtagagacgggttttagccatgttcccagcctgttttagcttattaaaaaaaattttttttttttgagacggagttttgctcttgttgcccaggctggagtgcagtggcgtgatctcagcaattctctgcctcagcttctcgattagctgggattacaggtgcccgccaccacaccaggaaaatttttgtattttttatagagacagggtttcaccatcttggccaggctggtcttgaactcctgacctcatgatccacctgcctcagcctcccaaagtgctgggattacaggcgtgagccaccgcacctggcctaaaatttttttttttagagacagggtctcactacgttgcttaggctggtcttaaagttccaggctcaaatgattctctcaccacagcctcctgagtagctgggattacacgcatcagcccctgtgcctggctacatctgtggttctttttttttttttttttttgagatggggcctccctatgttgcaatggcacgatctcagctcactgcaacatctgcctcccaagttcaagcgattctctcacctctgcctccccagtagctgggactacaggcttgcgccactatgcccagctaatttttgtattttttttttttttgagacagagtctcgcactgttgcctaggcagtggcgtgatctcggttcactgcaacctctgcctcccaggttcaagcgattttcccacctcagcctgccgagtagctgggattacaggcgcctgccaccatgcctggctaatttttttttgttttttgaggcggagtcttgctgtgttgcccaggctggagtgcagtggcgcaatctcggctcactgcaagctccgcctcccgggttcacgccattctcctgcctcagcctcccgagtagcactttgggaggccgaggtgggcagatcacctgaggtcaggagtttgagactaacctggcgaacatggcaaaaccccatctctactaaaaataaaaaaattagctgggtgcagtggctcgcgtctgtaatcccagcactttgggaggccaaagcaggaggatcacttaagctcaggagttcaagaccagcctgggcaacatggtgaaaccttgtctctactaaaaatgcaaaaatgagccaggcgtggtggtgtgtgcctgtagtcccagctacttgggaggatgaggcaggagaatcgcttgaacctgggaggcagaggttgcagtgagtcaagatcacaccccagcactctagcctggacaacatagcaagactcagtgtccaaaaaaaaaaaaaaaaaaagaaatgtttgttttggccagatgcagtggctcacagctgtaatcccagcactttgggaggccaatgcaggaggaggatcacttgagcccaggagttagagaccagcctaggtaacatagcaagtctgtgtctctccaaaaaaatttaaaaatcagctgggtgtggctaggaacggtggctcaaccctgtaatcccagcactttgggaggccaagaaggacagatcatgaggtcaggagtttgagaccagtctggccaacatagtgaaaccccctctctactaaaaacacaaaaagttagccgggtgtggtggtgtgcgcctgtaatcccaactactccggaggctgaagcaggagaatcccgtgaacctgggaggtggaggttgcagtgagccgagatcgcaccattgcactccagcccgggagacagtgcgagacaccatctcaaaaaaaaaaaaaaaaaaaaatcagctgggtgtggtggtgaccccctgtcgtcccagctaccgggaggctgagaggctgaggtgggaagattgcttgagctgtcaaggctgcagcgagctgagatcctgccactgcactcctggctaggggatggtgcaagaccctgtctcaaagagttaaaaaaaaaaagaaagaaaaatttattttgatttttcattagagtataggctctgaagtttcatttgtgcatatgagttacgtatccttcatatataagtgtatctatatttgccgtgtctaccagtcagactacaaaaggcatacatatggtggaatgatgatttgctatttcagtgaatgcatatattcctcactgtgaactagttattatttggggctgttagttgctgcaatgagacatcacacctctgaaaccatggggtgtcttaggagacttgttagagggcttgttataccatttggacttgtggctggtgattttggggagggtccaaggacaggggtgtgttttggattggtgctgtactaacaggggcaactcaaagattattattatttttttttttgagatggagtctcgctttttcacccaagctggagtgcagtggcgcgatctcggctcactgcaggctccgccccgcggggttcacgccattctcctgcctcagcctcccgagtagctgggactacaggcgcccgccacctcgcccggctaattttttgtatttttagtagagacggggtttcaccgtgttagccaggatggtctcgatttcctgacctcgtgatccgcccgcctcggcctcccaaagtgctgggattacaggcgtgagccaccgcgcccggccactcaaagattatttcaacaattttaggtggggcgcggtggctcatgcctgtaatcccagcactctgggaggccgaggcaggcgatcacttgaggtcaggagtttgagaccagcctggccaacctggtgaaaccccatctctactaggtggcaggtgcctgtaatcccagctattcgagaggctgagacaggagaattgcttgaacctgggaggcagaggttgcagtgagccgaaattgtgctacttcactccagcctgggcgacagagcaagactccttctcaaaaaaaaaaaaaaaaaattttttttaaatccagaaagcaggaggaatagagaggagctaaagctgtcattggagaaaaagcagtaattactcatgctagctgaagaagggatgtttattcttctgtgtgtgtggttgcgcagtgccagtttttatttatgcaggcaagatcactgatcggaattattttctccttccctcagtcacagaaagaactcgtctgatatcaattttctgtgaacctgtttatgttcatcaagtaatccaggccagctaccgtgggtctcagggcttttttttttttttttttttttttttgggacagagtctcgctcttgttgcccaggctggagtgcaatggcgagatctcggctcacagcaacctctgcctcccgggtgcaagctattctcctgcctcagcctcccgaataactgggatcacaggcatgtgccaccacacccagctaattttgaatttttagtagagttggagtttcaccatgtaggccagactgatcttaaactcctgatctcaggtgatccacccgccttggcctcccaatgtgttaggattacaggcgtaagccaccacgcccgggctttttattttttttcttaatgatgctgcacctaatcacatttaggtggcaggcaaaagaatattgcttagctgctttgctacagaaatgacaactcttgggcaggggcgcggtggctcacgcctgtaatcctaccactttgggaggccgaggccagtggatcacctgaggtcaagagttcgacaccaggccgggcacggtggctcatgcctgtaatcccagcactttgggaggccgagacgggcggatcacgaggtcaggagatcaagaccaacctggctaacacggtgaaaccccgtctctactaaaaatacaaaaaattagccgggcgtggtggcgggcgcctgtagtcccagctactcgggaggctgaggcaagacaatggcgtgaccctgggaggcggagcttgcagtgagctgagatcgcgccactgcactccaccctgggtgacagagcgagactccgtctcaaaaaaaaaaaaaaaaaaaaaaaaaaagagttcgacaccagcctggccaaaatggtgaaaccccatctctactaaaaacaaaaaaaattaaccgggcgtggtggcggacgactgtaatcccagctactcgggagcctgaggtaggagaatcacttgaactcgggaggcggaggttgcagtgagccaagatcgcgccactgcactccagcctgggcaacaagagcgaaacttcgtctccaaaaaaaaaaaaaaaaaaaaggacaacttttgatccctgaggctgctaattccaactgtgtgcatgtgcttaacaaatacctccgcacccaggcctgggaagttggctgatttgtgtacagcaaatacggcaggcctgatgtagcagaactctgacgaaaacgaactggacgcgtatttctcctgcagcgaaggtcacgctgctgacagcctctgctttgcactttgtccctgggaaggaggcctgtggccagtcctacctcctggaaagccggggtgcgtcagaggacctgatgcggagcggggaccccatcctctccgtgtctccccaagagccggcggcagaggctgcctgcgctccttaagctaggtcagttctctggcccgcagttctcgttctcctaacatcctccgcagaaaacgaccttcattttttcctcttgcgccagtcttgaagcggggcgtcctttgggctcacgttgcggcgcccagcggcctcaagcgtcagctgcctccagggcctcaggagcagtggctagggcctgccctccagcgcccggggtcctcggcccagccctgctccgagcgcgtcacaatggcgtcgcggccccgcccccggacgcccagccgcggtcccagcgaccttcgctttcgtggggaagccggactgcgccgtgtcttcctgaagaaggctggggtaagagtccggccagcggacaagagggcagctggtagcagggtgggatgcccgtggcatagggccgagcccccgctaggcacgcgggagcagcaaggcttccggaagcgcagggagcgctggactggcgggcgcccgggattcgcgcaggccccgcccctcggcggccccgcccagggagcgctgcggcagtttccatggtgagatggtcaacaagcctgtaagttcctcagctacgactaccaggtacctcgggttcctccctcctccgagagaccgccgaggtgcgggctgtgagagggggagcgtggagcctccgaggccgaggtgaggggcggccggcgggcaggggccgggtctgaggtcgagggccgcacacccaggatcgagcggggactgggcccgctgggggtggggaccgtggggctgggatttgggatcagggcgagtcgtggcagagagaacccggaggatctttgaccccagtgcgggagcggccagcccaccctagagaagcgagacaagggcaaccagaaggaaccgagtctgaggaagcgcttcctctgggcagggatattgggagagtcctggacgagtgaccctggacctaggaggcatgagaggtctacacacacttgcaaggataccttcatgattgttgagttgtggtgagaaaagaggctctttttagtttattttttaaggcagtacattcacatccttaagagtcagaaacttgcacaaggccttattactcaaaactcccttttcccagttccttctgaggaaatagttgcaaatctttgaacttttttcctccggaaattttctttttttctcttacatcggcagctcttcactgtgttcttccttcattagctttactaagtttgtattctttggttggaaatatttatttatttatttatttataaatagaaacaggggtatcactatgttgctcaggctggtcttgaactcctgggctcaagtgattctcctgctttagctttccaaagtgcggggattacaggctgaaccaccgcctgccaccgaaatatttcttcattgagttcctttgcctcctagtgttacttttctgctgtgtgtgtaatagccatttgttttttctttctcctttctggtcatatccttaaatacattttgcactaattccttttgaaacctcatcatggagagaacttgaatttagcagattaggggtgagtgcaggcttttgtcttaggttccatatatatatatattttgaggtggagtctccctctgtcgcccaggctggagtgcagtggcgtgattttggctcactgaaacctccacctcctggcttcaagcaattctcctgcctcagcctcccaagtgacgagggttacaggcacgtgccaccacacccggctaatttttgtatttttagtagagacagggttttgccttgttggccaggctggtctcgaattattgacctcaggtgatccacctgcctcagccccccaaagtgctgggattacaggcgtgagccactgcacccagcccccatatattaagaaatatacccttgtgtattgttggtaagaatgtaaaatggtacagcagctatggaaaacagtatggcagttccctcaaaaaattaacaaatagaattgccatatgatccagcagtaccacttctgggtctgaatccaagagaaatgaaagcggggactcagttacttgtacagtcatgttcatagcagcattatttgcaatagtcaaaagggagaggtaaccccagtgtccattgatagatggataaacaaaatgtgtcatatacaatagaatatcattcagccttaggaagaaaatcttggctggatgcagcggctcatgctggtaatcccagcactttgggaggccaaggtgggaggattgcttgagtccaggagttccagaccagcctgagcaacatagcgagatcctgtttccacaaaaaataaaataaaataaagaatacaaaaattagctgggcaggccgggcgcggtgtctcacgcctgtagtcccagcactttgggaggtcgaggtgggtggatcagagggtcaggagtttgagaccagcctggccaatatggtgaaaccttgtctctactaaaagtacaaaaatattagccgggcatggtggcacatgcctgtaatcccagctacttgagaggctgaggcagaagaattgcttgaatccgggaggccgaggttgcagtgagccgagatcacgccactgcactccagcctgggtgacagaacgagattccgtctcaaaaaaaaatcagctgggcattgtggcatgtgcctgtagtcctagctactctggaagctgaagtcggaggattacatgtgcctaggaggttgaggcttcagtgagccatgattgcactgctgtactccaccctgagtgacagagcaagactccatctcttcaaaaaataaaaataagatggccgggtgcggtggctaacgcctgtaatcccagcacttggggaggccgaggagggcagatcacctaaggtcaggagttcaagaccagcctggccaacatggtgaaaccctgtctctactaaaaatacaaaaattagctgggcatggtggtgggcgcctgtaatcccaactactcaggaagctgaggcagggagaattgcttgaacctgggaggtggaggttgcagtgagccgagatggcaccactacactctagcctgggtgacagagtgagactccatctcaaaaataaataaataagtgaaaataaaaaagaaaatgtcatatgctgcaacatggatgaatgttgacgatattatgttaagtgaagtaaaccagtaatggacaaatattgtatgatccccacttatatgagaatctgaagtagtcaaattcatgtaaacagaaaagtagaatggtggttgctagaggctgcggtaaggaggaatgggaagttgtttaatgggtacagagtttcagatttgcaagatgaaaatgttctagagatctgtttcacaacaatgtgaatctacttaagactgaactgtacactttaaaaaggttaattggtaagttttgttttatatatatatatatttttttttttgaggcgaagtttcactcatgttgcccaggctggagtgcagtggagagatctcagctaactgcagcctctgcctgcccggctcaagcaattctcctgcctcagcctcccgagtagctaggattacaggtgcccgccaccatgcctggctaattttttatatttttagtagagacgggcttttggcatgttggccaggctgatctcaaactcctggcctcaggtaatacgcccgcctcggcctcccaaagtgctgggattacaggtgtgaaccactgtgccctgcctatatttttaatcaaaggagtttaaggacgggcacagtggctcacacctataatcccagcactttgggagtccgaagtggtaggatcacctgagatcagcagtttgagaccagcctgttcaacatggtaaaaccctatctgtaccaaaaaatacaaaaattagcccggcatggtaatgcttacctgtagtcccagctacttgggaggctgatgtgggagaatctcttgaatctgggaggcagaggcagcagtgagctgagattgcgccactgcactccagcctgggcaacagagtgagactctgtctcaaaaaaaaaaaagaaaaaaagaaacagaagactaccctcatatttgtggtcctttgtgtagttccgcctcatggctccctcctttgccctagggtaaccactgtcttcaactttatgcttgtcacttaacttgcttttctttataatttgactaaaattgtttgtatcccaaaaaaagacatattgagtagttttgcataaccttggactttttttttgttgtttgtttttgagagagtcactgtgttgcctaggctggagtgcagttgtgtgatcatagttcactgtagcctcgatcttcttggctccagaaatcctcccaccttagcctcccaagtagctaggaccacaggtaaatgctaccacacctggttaaattttttttttttttttttttttttttttttttttggtggagacagggtctccctgtattgcccaggctggtcttgaactcgtgggcttaagcaatccttccacctcagcctctcaaagtgcaggtattacaggcatgagccaggctgctttcaaactcctaacctcaagtgatccacttggcttggcctcccaaagtgctgggagtatagacatgagccactgcaccagaccgctttgcctttttttttgagacggagtctcactccttcgcccaggctggagtgcagtggcacgatctcggctcactgcaacttccgcctcccgggttccagcaattctcctgtctcagcctcccgactagctgggactacagacacctgccaccgggcccggctaattttttgtatttttagtagagacggggtttcaccttgttggtcaggttggtctcgaactcctgacctcaggtgatccacccacctcggcctcctaaagttctgggattacaggcatgagccaccgcgcctggccaatttttgtagagacagggttttgccatgttgccccagctagtcagggtctctctgtcacccaggcgggagttgcagtggtgcgatctcggctcactgcaacgtctgcctcctgggttcaagtgattctcctgcctcagcctcctgagtaccttggattataggtgcatgccactgtgcttggctgatttttgtatttctagttgagacggggtttcaccatgttggccaggcatgtcttgaactcctgacctcaagtgatccacccgcgttggcctcccaaagttctgggattacaggcgtgagccaccatgcccagccttcccctgtctttacatataaattttagaataaggttgtttataaaatatcttgctgtggttggccatgtaggcttatgcctgtaatctgagtgctttgggaggtagaggcgggaaaatcaaagtcaggagttcaagaccagtctggccaatgtagctaaccctgtctgtacgaaaaaaaattttaaatttagctggatgtgatggcacatgcctgtactgtagtcctagctacttgggacactgcggtgtaaggtttgcttgagctcagacgtttgaggttatagtgagctatagtaacaccactaacactgtaccctagcctggtctacagagggagaccctgtctctaaaacaacaacaacaacaacaacaacaacaacaaaaaaaaaacaaagaaaaaaactcttgctgtgaatttgataggaaaaatgttcaatttatatattgttttggaattttggagagcactgacgtctttattctattgagtcttttaatccattaacatagtacgtctcttcatttgcttagattttcctgaatttatttatttatttatttatttatttttttgagacggagtttcactctgtcacccaggctggagtgcagtggcacgatctcggctcactgcaacctccaccctccgggttgaaatgattctccttcctcagcctcctgagtagctgggactacaggcgcctgccactgcgcctggctaattttttgtatttttagtagagatggggtttcaccatcttggccaggctggtcttgaactcctgacctcgtgatccacccgccttagcctcccaaaatgctgggattacaggcgtgagacaccgcgcccagccctggaattattttataagcattttgtagtattcagggtacaagttgtgttcagcgtacaagtctgatatgtgtttgttagatttatagctaagtgtgcttgcttcgacagcacatatactaaaattggaatgatacagagattagcaatttaaagtattttttaaatttatagcttagtaattttttcaattattacaaatggtattttatttttaatttaatttaggtgtccatgttttattgctaatatatagaaatacagttgattttttagttgagcttatgttctatgacctttctaaacttactcgttctagcttttttttttttttttttgagacagagttttgctcttgtcgctcaggctggagtgcaatggcatgatctctgctcactgcaacctctgcctcctggattcaagcaattctcctgcctcagcctcccgagtagctgggattacaggcacccgccaccacgcctggctaatttttataatttttaggagagacgaggtttcaccatgttagccaggctggtctcgaactcctgacctcaggtgatccacccaccttggccttccaaagtgctgggatgacaggcctgagctatcctgctgggcctagtttttgtttttgtttttttttttttgagatggagtcttgctctgtcacccaggctggagtgcaatggagcaatcacggctcactgaaacctccccctaccgggttcaagagattctcctgcctcagcctcccaagtagctgggattacaggcacatgccaccgcacccagctaatttttgtatttttagtagagatgaggtgtcaccatgttggccaggctggtctcgaactcctgacctcaggtaatccacctgcctcagcctcccaaagtgctgggattacaggagtgagccaccatgcccggcccgttttttttgttttaatcaattttttttgtagagatggaggtctcactatgtcacctagggtggtctcaaactcctagcctcaagcaattccccccaactcagcctcccaaagtgttgggagtacagacacgaaccactgcacctagtggaggagttgtctttttgtatattgcttgaattttttttttttttttgtagacacagtctctctctgtcacccaggctggagtgcaatggcgtgatcttggctcactgcaacctctgcctcccgggttcaagcgattcctctgcctcagcctcctgagtaactgggactgcaggtgtgcaccaccacacctggctaattttttgtatttttagtagagatggggttttcaccatgttagccaggatggtctccatctcctgacctcgtgatccgcctgcctcggcctcccaaagtgctgagattacaggcgtgagccaccgcgcccggctcctaaaagttttctaacaaagctccttctctccttgtcctttggctagaaagcgacagattttcttaggcttttaaaatctgtacccattgatgttttcagattgctggcttctgtaacatctagtctgggatatatgaggcaaaaagaatacccagtgaacccagcactgtgtcgttctttgagttccaagatcccgtgctggtctgctattttctacctttcagtccatatcatgtttatttatatataatttcagggtattgagctttacttaatgggaggagtatgaagcagtaccctgaactggaagtgttgctttcatttttgaaagacatttttgttgccgggcgtggtggctttcctttgtttaggtttcattgagcttcttggaattataggtttacaggttgttcgttttttgtttgtttgtttgtttttgagattaggtttcactctgtcacccaggctggagtggcatgatctcagctcactgcaacctctgcctccgggctcaggtcagcctctcatctcagcatcccaagtggctgggaccacaggcgcacaccactccaggctaatttttttatgtttttggtagagatggggtttcaccatgttgcccaagctggtcttgaactccagagctgaagtgatcctcctgcctcggcctcccaggcagtgctgggattacaggtgtgagccactgcagctggccttagatttatgggtttttattgtaagggtagaaagatttaggccatcatctctttgaatattttttatgccaacaaccccccatcctccttccagttatgtatatcttaggctgctttaaatcatgacacagctcagtgatgttcttttcattgttttggatttttttttcagaaatgaacttagttgcctttaagttcagtaatcttttcttctgtaatgtctaatctgctgttcatttcattcagtgtatttttcatctcaaacgtggttttcattttcagaatttttttttttttctttagagacgagatcttactaggttgtgcaggctggtcttgaattcctgggctcaagcaattttctcacctcagccttccaaagtgctgggattataggtgtgaatcaccacaactggcccactttcagaattttgactggatgtttttatatctttcctatactgtaattctcattgtaggtcatgttttcttgcctgtttgcatgcctggtatcttattggatgttaggcattgtgaattttactttttggatgcaggatatttttgtattcctgtgaatcttcttgagctttattctgggatatagttaagttacctgaaaacagtttgttctctttggtttttgtcttttcaggattattaggcaggtccagggcattgttcattctggggcaaattattccccactgctaaggctagatcttcctgagtactttacccaatgggccatgaattatgacattttctttttttttttttgatcctcaaaaattttattttattttgttttaatttttttttagtatttattgatcattcttgggtgtttctccgaggggggatttggcagggtcataggacaatagaggagagaagttcagcagataaacatgtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcatggggttgggagtaaggttatagattaacagcatcccaaggcagaagaatttttcttagtacagaacaaaatggagtctcctatgtctacttctttctacacagacacagtaacaatctgatctctctttctttgccccacgtttcccccttttctattcgacaaaaccgccgtcgtcatcatggcccgttctcaatgagctgttgggtacacctcccagacggggtggtggccgggcagaggggctcctcacttcccagacgtggcggccaggcagaggcgccacccacctcccagacggggtggctgctgggcgggggcgccccccacctcccagacggggtggccgggcggagactctcctcacttcccagacggtgcggctgccaggcggagaggctcctcacttctcagacggggcggccgggcagaggcactcctcagttcccagacagggtcgccgccgggcagaggcgctcctcacctcccagatggggtggtggccgggcagaggcgctcctcacctcccagacggggtggcggccgggtagagatgctcctcacctcccagacggggcggccgggcagaggcgctcctcacatcccagacagggcggccgggcaggggcgctccccacatcctagacgatgggcgcccgggcagagacgctcctctcttcctagacgggatgacggccgggaagaggcgctcctcacttcccagactgggctgccgggcagaggggctcctcacatcccagatgatgggcggccaggcagagacgctcctcacttcctagaccgggtggcggctgggaagaggctgcaatctcagcactttgggaggccaaggcaggcggctgggaggtggtggttgtagtgagcggagatcacgccactgcactccagcctgggcaacattgagcactgagtgagcgagactctgtctgcaatcccggcacctcaggaggccgaggcaggcagatgactcgaggtcaggagctggagaccagcctggccaacacggcgaaaccccgtctccaccaaaaaaaaaaccagtcaggcgtggcagcgtgcccctacaatcccaggcactcggcaggctgaggcaggagaatcaggcagggaggttgcagtgagccgaaatcgaggcagtacagtccagcagagggagacggtggaaagcgggagacggagatgagggagagggggagaccgtggaaagcgggagacggagacgacggagaggggagagggagaacaacattttttttttgagacagagtctcgctctgttgcccaggctggagtgcagtggcacgatcttagctcactgtaacctccacctcacggattcaagtgattctcctgccttagcctcctgagagctgggattacaggcatgtgccaccatgcccagctaatttctgtatttttagtaaagacggggtttcactatgttggccaggctggtcttgaactcctgacctcaagtgatctgcctgcctcgggctcccaaagtgctgggattacaggcgtgagccaccacgcacagcctgaattatgacatttctaatctgcctggtgtaggaacaggcactattccatgccctgtgtgagcactgggcactattccctctgatctttttagatggttcttttgacagatgtgggtaatgcccttatactcatgtactgatcaatacactgctgagctctcaagtgggacgctgcaggtctctggggttttctctccatgcagctctttcttctctggtgctgtgttctgtgaattctagctgcctgtgtctccccagactatcaaatctatcttttcaactcaaggaatctgccaggctctgccttagttatttttccttgtagcacattctacaaactactcaagtcagttagctggggcacttgtaggactcatctcatttgtttcctatctcttagggattactctctgttttctgatgttcagggtcttggaaaccattttttttttttttttttttttgagacggagtctcactctgtcgcccaggctggagtgcagtggtgcgatctcggcttactgcaagttccacctcccgggttcacgctattctcctgcctcagcctccggagtagctgggactataggtgcctgccatcatgcccggctaattttttgtattttttgtagagacggggtttcaccgtgttggccaggatggtctcgatctcctgacctcgtgatccacctgcctcagcctcccaaagtgctgggattacaggcgtgagccaccatgcctggccaattggaaaccatttttgtccttacgttttgtcaaaaaatgttttttttttccaatataacctggtccctgttactcaattcgtcttgcgctgaagtggagaattgaagatggggcatcaagcattcatttcatctcttattgaattctaataataaaagtacagttgacccttaaacaaaatgggtttgacctgtgtgggtctatgtatatgtggatttttttcttttttaaggagatggggtcggctgggtgcggtggctcctgcctgtaatcccagcacattgggaggccgaggcaagtggatcacttgaggccaggagtttgagactgacctggccaagatggcgaaaccctgtctctaccaaaaatataaaaaattagctgggcgcggtggcgcacacctgtagtcccagctatcggggaggctgagacaggagaatcgcttgaaccttggagatggaggttgcagtgagccaagatcttgccactgtactccagcctaggtgacagaggaagactccgtttcaaaaaaataaatatataaaaataaaaaaaatgagctgggcattgtggcagatgcccatagtcccagctactggagaggatgaagcaggaggatcacttgagcaggagatagaggctgtggtgagctctgattgcatcactgcactccaggctgggtgacagagtaagaacctgtctccgaaaaaaaaaaaaaaaaaaaaaggctgggtgcagtggctcaggcctgtaatcccagcactttgggagggtgagccaggcagattgcctgagctcaggagtttgagaccagcctgggggacatggtgaaaccctgtctctactgaaatacaaaaaattagcagggcatggcggcgtgggcctgtaatcccagctactttggaggctgaggcaggagaatcgcttgaacctgggaggcgaaggttgcagtgagccaagattgtgccactgcactccagcctcagcgacagagcgagactctgtctccaaaaaaaaaaatcaactgtatatctaatggtactgaaaagagagaaaccacaagacactggtatatattgacatacacaagtcacagagaatagaaatggactggatgttgaagcacagtgatgcatatattattattcaagtcaactcactatttaaagctaatttcataggaaaattctacttaattcagtctaacattatgtaagtaaccaaggaagagttaacagctgtgttacagaagtgaactataagcttgtgaattcagtatttaaaaaaaaattccttttcagtattttgtaatgcttcaacatgcattttgagcttatttctgtttatattgttgtaatgttcctcagcagttaacatgtattgaagcattttttttttttttttaatgagactgagtctcactctgtcgcccagtctggagtgcagtggcactatttcagctcactgtaacctccgcctcctgtgttcaagtgattttcctgcctcagcctcccaagtagctcgaattacaggcacccaccaccactcctggctaatttttgtattattagtagagacggggtttccccatgttggccaggctggtctcgaactcctgacctcaggtgatccacctgccttggcccccaaagtgctgtgattacaggtgtgagccaccatgccaggcctgaatgtttacttttacttttaatgtaagttttaatttaaatactgatacttgattcagttattggaaaacttttttgttttgagacggagttttgctctttttgcccgggctggagtgcaatggcacgttcttggctcactgcaacctccgcctctcgggttcaagtgattctcctgcatcagcctcccgagtacctgggattattggcatgtgccaccacacccggctaggctaattttgtatttttagtagatacagggtttctccatgttggtcagtttggtctcgaactcccaacctcaggtgatccatccgacttggcctcccaaaatgctgggattacaggtgtgagccaccaagcccggcctcttttttgctttgtttttttttgagacggagtctcactctgttgcccaggctggagtgcaatggtgagatatcggctcaccacaacctctgcatcctgggttcaagtgattctgctgcctcagcctcctgagtatctgggattacaggaatgtgctaccacacctggctaattttttgtattttgagtagagacggggtttcaccatgttggccaggagttcgactcctgacctcaggtgatctgcccgcctcggcctcccaaagtgctgggattataggcgtgagccaccatgcccagccggaaagcttttaagtgcccagaataatttgggtgtgtgaatgcctttttatccatagtaaatttaataaaatctaattatagatcaagtatttctgatgtaaatttagcatctaaatttaagtggctgtgaagtataaaataacagtagataccaatgacttagaagaaaaaaaagccttgacatctctatttcctcgtctctaaaggtgataacacttgcactatggtgatcctactagtaatacatttggagccacgttgtaaacttcagagtttgcaccattattattatttttttattattattattttttgagatggagtttcgctcttgttgcccaggctggagtgcaatggcgcgatcttggctcactgcaacctccatctcccaggttcaaggattctcctgccccagcctccctaatagctgggattacaggcatgtgccaccacgcccagctaattttgtatttttagtagagacggggtttttccatgttggtcagactgcttgtgaactcccgacctcaggtgatacgcttgcctcggccttccaaagtgctgggattacaggcgtgaaccaccatggatggcctattattattattattagagatggagttttgctcttgttgcccagtctggagtgcaatggtgcgatctcagctcactgcaaactccacctcctggatccaagtgattctcctgcctcagcctcctgagtagctgggattacaggtgtgcgccaccaggcctggctaattttgtatttttagtagagacggggtttcaccatgttggtcaggctggtctcgaagtcctgatctcaggtgatccacccgccttggcctcccaaagtgctgggattatagacttgagccactgtgcctggccaaagtttgcaccattattattattattatttttcttttgagatggagttttgctcttgttgcccaggctggagtgcaatggcgtgatctcggctcactgcagcctccacctcccgggttcaagcagttctcctgcctcagcctcctgagtagctgggattacaggcatgggccaccacgcctggctaattttgtatttttagtagagacggggtttctccatgttggtcaggctagtctcgaactcccgacttcaggtgatcctcctacctcagcctcgcaaagtgctgggattacaggcgtgagccaccgcacctggccagtttgcaccattattatgggagcacttgcaaagcctgccagttgatggtagggtggaaaagaagaggacaactagaagagagttcctacaccgcaaagtaaactttgctggctctgcgaggagcaggaaacctgcatgatgagaacaaggactgggtggcactgcaggaaatgctcaattcgagtttcacttcctgtgttatcactttttctttgctgcaatttcatctttgttggtcaattctcttttaattttccatttttttacattctatgtaaatgtagtttttatgaactagagagtctgactccatattttatctttgactactgtcagctctcaagccccacctcttccctccccttctgtcccacacctggatggctgattcaaaagcccaggtgcttcctcttttggctctaaaggcaagttcaagccatgcaggccccagcatgtgcattggagccttcatttcccccccactccttaaccttaataacacccaaagccagtctctcttccctgctctcaagccatttttttttcttctttttctggagacagggtcttgtgtcacccaggctggcgtgcagggccctgatcacagctgccagtagctggaaccacgggggtgtgccaccacgcctggctaattttttaattttttttttgtagagatgaggagtgccactgtgttgcccaggctggtctcaaaactcctgagctcaagtgatcctctcttggcttggcctcccaaaatgctggggttacaggcatgagccattgcacccagccttaagctatttttgaacccatttgggattcatccctgttctccccagaaagcctcatgtgagtcataagcctttacatattctctctgtgcatgtggggctgtcaccagttttgaaaaaccaggttttgggtggggaatctatctcgtatctttgggtaatatcacagataaatacagcagacattaacattttattcagtaaccactgacagtaggggaaagagctgagctccattctgatttgtgcagtgatgatcgggctttttttctttttttggtggttggatattttatacctttttttccccaaatactctccactgaatgtagtcgactggtgattttaaagggggaatgagggagtatggaggggtatgagttggggctcagtagagttggggatgtgaaaaattacaagggaccagtgtaaatgtgatgaggccagcggtgtctgcctgctggcaatggtcaaagttagattccatcctcccacagagactgggagacagaggccttatctttcccaatcactacatttcaaagcaatggctccttgagaaagcaatgttccttgagaaagacacttcttagctgtaggagatacacacttgcatacacatacacaacatgtgtatcacataaacatctcaaagggacagaggacagattcataattgtaagtcctttttagtaaatgctcttaagagagggcggtcaggagcctatggtcagatattggcaagaatagtaagttatcctggcagcactgagatttctcaggcaggcattttaatggtggggacaggggtcatcctgggaacacaggctatgctactagaagccatgccaatttgtctctcagtgcagagtttcagatggagttatggggggagagttctgcagttctcagtaaccacaacagtatatatcactggaagatgaagcccacacaactacagatgttactgtttctgagtgagccgaataacaaacttacagtgagcagtcaccaacagacagaagtgatgtgattggttactgatcatgacatgcatttgttattaatgtgatgatgtgtagactgaagagctagcagcctgcactttatgcgaaaactcacagttaatatactgtgtacctgaaatttgagttgtgtcgttgggggactggtgttattaaatcatggtgactgaaattcgtgcatatcagaactgtaccaagcaagggctgcctgatgagtataatgctctcatgttttatgggaatttatataaatttaaaataatatgaataaatatttgaaagttgtatgttatgcacaaggtttgaaataatgcaattcttttaatattttaaaaaattgttaggactcagattttcttttatcttttcttttttttaaggtacggagtctcgctctgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgagccactgcacctggccctcgactcacagattttcaaaatacttttgaacagtaagctgaggacagtgtttattatgactatactggtctcctttcactagctcacaaaatttaactacatcacttgtcagtctcctaaaaatgcagtgtatgtgctttgaaacttgtgaatgatctgctgatttgtgctattttatattcaatgttgttgaaagaatagtttttaaaccaagtaatgcaaaaatttagtgtaacatgaatgcttgtgctgtaaaacatactggaaaatcaatagctctggaataaactttggatttttaattaaaattgattttgatgtacttatgctgttaaattggtagagactagtctgaaaagctgagaaaagataaagcagaattaaaacaaaatctatcttattcgtagagccatgtcaagaatgcattctctctacacctattccaatgggcacattagtacttgattatgcagggagtgaatcatgccaagtcttcacgtacacattgctcctatcactgctgtgcagtgagccgtgactgcgccactacactccagcctgggcaacagagccagaccttgtctcaaaaaaaaaaaaaaaaaaaagtcctttaagggatacgaggctgtgtgtgatagtcgttttcttttagtttgcacttttttttttttttttggagacagtctcgctctgttgccccgtccggagtgcagtgggtccatctcggctcactgcaagctccgcctcccgggttcaaggccttctcctgcctcagcctcccgagtagctggaactataggcgcccgccaccacgcccggccaattttttttgtattttttagtagagacggggtttcaccgtgttagccaggatggtctcgatctcctgacctcctgatccgcccgcctcggcctcccaaagtgctgggtttacaggcgtgagccacggcgcacggcctagtttgcacttttattcacccccaaattctgtgtattgcaagtaagtctcaaattttgagaagcgagcaccatcccattggcatcgtgactaccaaccaccacatcactcagctgctttgctttccgggagaatccctgcgccgtgggttcgctcgcctttccatgcctgccgtgcaggcgtcctttgcggtcttttgtccacgtccgggtcaacgcctgacgcgccccttcccggctggacgacgcagctcagggcggggcgaggcgaggttgtgtcgcggaacctgacgggaaacggcccctctaggtccgtggcgcggcgcgcttgtggcagcgacgggcactgccgcgcatgcgcggcccatttccgagagtggcagggctgggcgcggtggggtcgcctctggggtcaaagagcacgccgagcccgccggagggcggggccgcggccttggccctttggcgcgtaggagacagcgcgccaggctggcagccggccttagcggcgtttgctgctcttgtgcggacgccactgcgcgccctagtggggactacggggacgcttcgcgctccaggaaggaggcgggcaccgcccgctctagcacagtccgggagctggacctcggggttcaccgctctgcttgcccactaaaagcccattcggcggaagtccagcgttgcatggttacagtactgagccccagacatcgttgccaagtataatgcaggctctgttttatcctggggcacttgtagtcagggttcgtgggcccgcacttcataatggagggctgcgggcctcgtctgaaccgtccagccagtgtgtcctcagtcgtcttggttgggtttttgaagaaccaacccgagattctggggcacagggagttacaagacttggggccctgatgtaagccccaaataaaatgattttggcccctagggccagatccgagtttctaaaaacagagcagcacttgtaaggtagaggaagcgtggcccacctgaatggggacttctcaccagagtttcacagcagcggaagacgaggctgaggaagagcacggcccatatttgcacggagaggcaatatgtaatgcctgtgctccacaagccaccccagctgactcaacaggagttttgctccagctgtcagagaggtgagctgggcctaaggctagggttaggcttgcccaggaaatgtctctccattttcagggttgagagaacctggttgggagggaaagaaatattactacctctaagaaaattatttttctttttcttttgagatggagtgtcgctctgtcgcccaggctggcgtgcagtggtgggatctcggctcactgtagcctctgcctcccgggttcaagcgattctcctgcctcagcctccagagtagctgagattacaggtgcgcgacaccatgcccggttaatttttgtatttttagtgaagatagattttcaccatgttggccaggctggtcttgaactcctgacctcaggtgatccgcgcgcctctgcctcccaaagtgttgggattacaggcgtgagccactgctcctggccaagaaaattatgtcttaaacaccccaacggcctttgaatttttctgaattatttactcattccagataccgagagcttcccatactatgccaattaccgcaggtggccttgagagatgtgggtgcttccaccatgcttactcagaaagtagttcaggaaacagtttcctggattaccaatttctgcctgacatgaaagatgaaaaccactgaactccagaggggtgaatgtccaggtcatcccattcattagctactccagaggctgaggcaggagaatcccttgagcccggaaggcggaggttgtagtgagccgagatagagccactgcactccagcctgggtgacagcgtgagactccatctccagaaaacaaaacaaaacaacaaaacaaaaaccctagcgcggtggctaacgcctgtaatcccgtcactttgggaggccgaggggggaggatcacaaggtcaggagttcgagaccagcctggccaacatagtgaaaccccgtctctactaaaaataaaaagatagctgggcatggtggcgcatgcctgtaatcccagctactccagaggctgaggcaggagaatcgcctaaaccctggaggtggaggttgcagtgagccgagattgcatcactgcactccagcctgggcgacaaagcaagactctgtcttggggaaaaaaaaaaaaaaaaaagaaaaagaaaagaattcctcatgagatcgcttgaacgcgcgagttggaggttgcagtgagccgagatcacaccactgcactccagcctgggcaacagagggagactccgcctcaattaaaaaaaaaaaaaaattcctcatgagacattaagagttacagctctttgccgggcagggtggctcatgcctgtaatcccagcactttgggaggccgaggcgggcggatcacgaggtcaggagatcgagaccatcttggctaacatggtgaaaccccgtctctactaaaaatacaaaaaattagctgggtgtggtggcgggcgcctgtagtcccagctactcgggaggctgaggcaggcgactggcctgaacccgggaggcggagcttgcagtgagctgagatcaggccactgcactccagcctgggtaacagagcgagactccgtctcaataaaaaaacaacaacaacaaaaacaaaacaaaacaaaaaaaaagagttacagctcttttagaatttgtctggcaggctttccagtttttgccagtgtgaacccaaaatatctgagataggcctcagttaatttagaaagtttattttgccaaagttgaggacacgcgcccatgacagcctcaggaggtgctgatgacatgcgccaatgtgggcagagcacactttggtttcgtacattttagggagacatgagacatcaatatatgtaagatgaacattggttcagtccggaaaggcaggacaactggaatcaaaggtgggacaacttgaagggcaggtggcttccggggtcttaggtacagaagagacaaatagttgcattcttttgagttgctaattagcctcttcaaaggaggcaatcagctttgcatttatcttagtgagcagaggggtaactttaaatagagtgagatgcaggtttgcccttagcagttcccagcttgacttttctctttagcttagtgattttggtgccccaagatttattttcctttcaccctggaaagccccttaaaaacaaaaaacaaaaaacaaaaaacagttcttggcattgaagtctaaaaaacattgtttttccggtcttcctgtagatgacttagtagagagtcttcagtctttcagtgagtaccagaaatcagtgcagtctgctgcttgtaattgagtacttcgtgtgggtcgagtactcagtcagtacatttctagggatggaggcaccttggtcccatagacctctttctgatggtcctgcttgatccaggcatagaagctgggatagctgcatgaaagaatggattatgtcaccttcagatacactccttaaatgtatgtgtagattgtacaacagcaaggttaaagctgtattttctggcaagtatctccacatttccctttcttattttgaacaacatgacttgctggatctgcctggtaggggtatccaaatgtcatggatactttagtgcttgccttaattgagcattctgtccagttgatgctcatgtttaatctccctaaaatgtcttctcagttggtttctgatctagtccttcctctgtaattatttcttttctgtcttgtccgtgaagtcttcttcctcttcctgcctctcattattgctgttcccaaggtatccagtctttttctttctttctttctttctttttttaggtgtagtctcactttgtctcccaggctagagtgcagtggcatggtcttggctcacttcatcctccgcctcccaggttcaagtgatcctcctgcctcagcctcccaagtagccgggactacaggtgtatgctaccacacctggctagtttttgtacttttagtagagacagggttttgccatgttggccaggctggtctcgaactcctgacctcaggtgatccacccaccttggactccccaaatgctgggattacaggcgtgagccactgcacctggcccttggtttgctgagactttttatcatccagtgggtattgaacttttaaaaaaaaatttttaagtcaggtctcactctgtcacgcagtctggagtgcagtgttgcgatcacagctcactgcaggtaactctgacttcagtctcccaggtagctggaactgcaggtgcacagcacaatgcctggctaatttgtttattttttgtacagacagggttttgccgtgttgctcaggctgtgagtttattattattattattattattattattattattattattattattttctgagatggagtctcgctctgtcgtccaggctggagtgcagtggctcaatctcagctcactgcaagctctgtctcctgggttcacgccattctcctgcctcagcctcccgagtagctgggactacaggcgcctgccaccacgcccagctaattttttgtatttttagttagagacagggtttcaccgtgtcagccaggatggtctcgatctcctgacctcatgatctgcccgccttggcctcccaaagtactgggattataggcatgagccaccgtgcccggccgttgaattattattatttttttagctaatagaccagaagaatgaatttaattattattgagatgattatattgttttattctttttcagtggattgattgatattaacctatggattgagttaattttattaatgttttgattttcaaatgttaaatcagcctattttccaggaacaaagtcatattgttgctttatccttttaaaatatattccatgacaaattgttagatatttttgtgtctttgttcctgaaagagtctgttgttttctttctttcttttttttttttttttttttgagaccaagttgtcgcccaggctggagtgcagtggcatgatctcagttcatggcaacctctgcctcccgggttcaagcgattctcatacctcagcctcctgagtagctgagattacaggtgtctgccaccatgcccagctaattttttgtatttttagtagatatggggtttcaccatcttgaccaggctggtcttgaactcctgacctcagatgccacccgcctcagcctcccaaagtgttgagactacaggtatgagccaccatgcctggctgttattttcctttcttaaaagtctttttttttttttgagaaagagtctcactctaatgcctagtctggagtgtagtggccctatctcagcttactgcaacctttgcctcccgagttcaagcgattcttgtgcctctgcctcccaagtatctgggattacaggcaggcaccaccaggactggctaatttttgtatttttagagagacagggtttcaccatattggcctggctggtcttgaactcctggcctcaagtgatctaacaccaccttggtctcccaaagtgctgggataacaggcgtgagctatcacacccggcctcttctaatatcttaattttttttttttttgagacagagtttcgctctcatcgcccaggctggagtgcaatggcgtgatctcggctcactgcaacctccacctccccagttcaagcgattcccctgccttagcctcctgagtagctaggattataggcgttagccaccacacccggctaatttttgtatttatagtagagatggggtttcatcatgtttgtcaggctggtctcaaacttctgacctcaggtgatctgcctgccttggcctcccaaagtgttgggattacaggcgtgagccaacatgcccggcccagtcttttgttttttttttttttttttgagacaaggtcttgctctgtcacccaggctggagcgcagtggtgtgatgatcataactcacctctcccttgaactcctgggctcaagcaatcttctgatctcagcctcctgagtagctgggactacaggcatgtaccataatgcctggttacttttttgtattttttttagagatggtgttttgctatgttgcccaggctggtcttgaactcctgggctcaagtgatcctcctgtcttggcctcccaaaacatcgggattacaggtatgagccactgcccccggcctttgttaggtttatatcaattttatgcctgtttcagaaaacatgtttagtgttttctctttattctccatgagtgcttgtgtaagattggtgctatttattccttaattgcttgtaaaattacagcagtgaatttttctagggtctggcttttctttatgaataattttaaaattatagatttaatttctttatattagggaaattatcctttagaacttgatacaagtcctagttgtttgtttctaccttgtcatttgtcatccccaggtgggtggcaggtgtgtttgttccagggcaaagctatgtctcacacacactagttcacataaccccattcagaccaaaaattgttcacagtttactttgctttttgtctctttatctccaaggttggtctgtagtgaactcaaagccttaattctatcccagtccttttagttaaggtcagcagtgacctctagtggtgaaatcttcagtcttcctcttaacatgactttcttttttaaaaattatctagtgaattactctttctgtttgtttgtttttgagatggagtcttgctctgttgcccaggctggagtgcagtggcacgaccccagattactgcaacctctgcctcccgaagtgctgggattgtagggttga

SEQ ID NO: 786 - DNA, 99117 bp, Homo sapiens
gcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaag

SEQ ID NO: 787 - DNA, 155385 bp, Homo sapiens
tccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcata

SEQ ID NO: 788 - DNA, 136090 bp, Homo sapiens
tgccaaaaaattccatggtttataataattctctccatacctattaccaaactagaaagttaaatatagatacaatatatatttctttttttaaaagcagaaatgcatgtatattactctgttctcacattgctagaaggaaataccccagattcattaatttataaagaaaataggttgaattgactcacagttctgcatgattgggaaggcctcaggtaacttacaatcatgcctcttcacagggtgggaggagagagaataagtgccagaaggggaaatgccagacacttgtaaaaccatcagatctcataagaactcactcacaaacagaacagcatgggggaaaccacatccatgactcaattacctcccacctcgtccctctcatgacacatgggcataatggagattaaaattcaagatgagatttgggcgaggacacagccacactatctcagtatgttatgtagtcccagctatttttaagactgacgtgggagaatcccttaagcccaggagtttgagtccagcttgggcaacatagcaagaccctgtctcagaaaagaaaaagaaagctagagagcagaacaccacatttagagtctaatttctctaaaagtgagataattcccaaaaccataaatgaaagcctgaaaacctgtgtacaactttctgtagattatttaccctaagggacaaaatgtaaaattgaagctctaccaaggaaaagagtcctttataaacaacaaggctttcatttgagaccacaagatactatctttgtatgactacgtcacaagaggatttactcttggagtaggaatgcacagacaataaggcagtcttcaaaggaactgaagtccagcttgcatcctctaattgcttgattgaattaagactatctgagattttttattctccaatcccaactcttgaggagaaacacaggaaattctctctttaaaaaaaaaatcccaaaaaattcttgaattgccacttttcatatgcaaaattgggcactcaaaaaaagtaacaaagtacagtagacaaggcatgattgaaagacaagtgcaataaaaaaaagatgatctagataatgaaatataagcatttttaataagtttagtatgaacaaatattaaaacaagataaacaataaaatgaacaaaataaactgaaaaactaaaatgtataataacaaattaaaaacataatggtgggatttaacagcaaattagagaaaaaattagagaattagtaaactgcaaaaaatattagaagaaaatatgcgatcaaagcagacagcaaaaaaagcaaatgcagaaaacagtataaaagagatataaaggacaaagtgtaaaactctgacatacttttaatttaattacaattccagaaaaaggagagaaagagaatcaggtaggcaaaatatttgaagagatattgctgaaaattctctaaaactgctgagcgatattaagctatgaatttataaggttttatgagtttcatgaagaatgaattttaaaaacaataatttgttttaaaaggataaacagaaaaggtacagcagaataaaagcaaaatacagacaaaaattttaagaacatactgcattcaagaaaataataataaggccatgtgtggtgcctcatgtctgtaatcacagcgctttgggaggccaagtcaggtggatcacttgaggccatgagtttgagaccagactagccaaatccagtctctaataaaaatacaaaattagccagttgtggtgccaggcacctgttatccaagctactagggaggctgaggcagaagaattgcttgaacctgggatgcagaggttgcagtgagttgagatggtgccactgcactccatattaggcaacagagcaagattctgtagaaggaaagaaggaaggaatgaaggaacgaaggaaaggagaggaaagaaggaaaggaaaggaaagagagaaaaggaagaaataaagaaggatagaaggaaagaaagaaagaaaagaaagaaataaaagaaagaagagaagaaagaaagagaaaagaaagaagaaaataataagactgacaaacttcttcttaaaagatgcagtgaaaaccaaaaggaaaaggaaatacctcttcacagtgataaatgaataaaaatgtcaacatagaatccatttaaaatctcacagaagtgaacgtaaaatacagagatttctgactaatttaaaaaatatttagagattctagaatcagccacaaattatggaataagagctctgaagaaggatctttggaaggaaggaaaaagctctgaaatggaaaaaaggaaatgcaggaaagaaggaagacaaattgaaagaagaaatatagcaataaataacatgaatgttaatcatatgtaaaattaataagtatgaaaccaaaagaaaagtggtggatttgaattcaatacataattaactttatctttttaatgagcaaaattctcctatttaagaaatagaacacaacggtaagagccttataagagaaacatcttaaataacagtgtgaaaaggtgaaaataaaataatagaataaagtgcataaattctgaccaaaagaacactatttctatgctaatatcagacaaaactagacttcaaggcaagaaatatttccagaaataaatttttataatggcaaaagattagcaatatgaagataaaattataaataggtacgcacctgaaagcacaactttatacgttattttttaaaatagactgagctaaaaggataaataggcaaatcaacaataatacaggaagattttagcacaactctaagtgctagaatacacacaaaaaaatttatgaagatatttatgattcaaacaaaaccatttagaaaatttgacccactgacataagagatcatcacatacaacaccaggaaaatagacattcttttcaggagcatatgaaacattttccaaaatcaatcatatactggttcataaaacaactctctatgaatttcctataatcaccataataaaatatgtcactgaacatcaagaaaatcagctagaaaataaaaaactaaaattacccagaaattttctatctcaaaattaaacaaaccacttttaaataatccattagtaaaaataaatcacagaagttaggaagtattttgagcctaataataatgaaaatacaacatatcaaagcttgtaaaactcagctaaaatattacttgcattttctagaaaataataaaaactgaaaatcagtgcactaaatatctattcaagaaaacatttcacttagcataatgtcctctaggtacattcgtgttattgcacatgatataaaaacatcccactgtactccacaaagaaagaaaaaaagaaagaaagagagaaaaaaagaaagaaaaaaagaaagaaagagaaagaagaaaataataagactgacaaacttcttcttagaagaattacttcttaaacaattactgtttgtcaattaaaaacaaaataaaacaaagaggttattaagtcttccaaggtcattcatgtcaaaaatagcagaatgatcttttgaaggtttaatgatatttgattatgaaatattattgcattacatatacaaaaacagagggcaaaaatacaaattttcatttttgttggatgaagtaatactggtgatgtaaggtacagcataatgtctgttgtcaataataccatatattatgtgagtataagtgtgcatgtgtacattagatagatagatgattgatgatagatagatagatagatagatagatagatagatagatagatagatgtcacattgcctctattcattcatctattgatggatatgtaagttgtttccatatcttggtgattatgaataatgctgcagttcatatgggagtgcaggttatctcttcaagatactaacttcattttcttttgatacataccaagtagtgggatttctggatcagatggtagttttatcctccatagtgccttctataatggctgtatcaatttacattcccgccaactatgtaacaggcttccctgttctccatactgaagggtaaataccacatgattttaattatatgtggaatctaaaaaaagaagtcaaactgataagatcagagcgtataatggtgattgggatggaatgcggggagaagaaaagagatgttgttcaaagagtacaaagatgcactcatgcagaatgagtaagttctggagagctaagttacagcatagagagtatacttgataataccatattgtacacttgaagtgtgctgagaaaatgcatcttaaatattctcaccaaacacaaaagttaattatgtgaggtgatgaacaggttgattgtggtaatcatttcacaatgtatacatttattaaaatatcacactgtacatcttaaatatatgttatatattttttgtcacatacacctcaatacagaaaataaaaaacaaactatgttttaaagattacaacaacaaaagaagtaactaatttgcatagaatggcaaaaacagacaaaagtagacaactgttgcactgtccctggaacgtagtctggaagcactggagtgaaggagggcagtaatttgagcagtcagtctggttttccactgtatgtggaaggaataataaccatacttatggatctacactgaaaatggacactggctaacaggtttgataagctaatgaggaaattggaaatttaaaaatggaaaaatgatgacaaagtagttggaagagcagtatgttctaatgatacctgaacctaaacgttaacctggatgcaaagaggggctgctctgggaaagggcatgcgacctttattgaggtggctttctgcaacttctaaagatactgaagtggatatcatctgaatgctgtctactaacagcacacccccaacagctggaaaaataaattcttctttcctaaatgaagggcaaggcagaacctcctcatgtatactgtaatatatcccttatgccatttgaatttatatattcttatacatgatcagaacagctcttctaggattctcttacttgaggggaattagaagagaaaggcttgaggacaaactatgtatcttgccactgaagctgatctgagttgcaacacaagggaataatgtagcctatagtaatccttttattttttcacaccttacttgttgcaaggttttgtgcttttccctcttccatcatcaaaagtagattttaacagcataattattttggcaatttaaatgtttacttgtaaaaaacaggatatgtaaactatcctctatagcttaagtaattaaaagtatactttaaaaactgaaagatagcattactatgacttcaatgtaaactactgttaacatttttctagaaaaacaatgatttaatgtagtttcctgagaacgtgacatttttcaaaagataaaattccataataacagaaaaccttcataatacatttcacagtcacacttttataaatctatttaaatgacagtagccaaggtactaacctgagcatatttatttactagtacatttactgggataatttttagatttataagtaaaaacccatattatgcttccagaacataacaggcatttgttcctttaccctcctacaaacttgacatgatctgaagttttaaactttcccgtcaaatatatctgaaattagtagtacacctttactaatatatcgtataaaatataacatcccacaaactaagattataattataaatatattggtttattatacatgtaatatggaacatgttttttcttatttggaaaatagaaaaagaaaaaattaggctatatattaaaaccaaagatacattccatatgtggaacaattttcatgtttgctagcttaactgtctaaattagaattctttaaaaactcatatggatttaagacattagctacatatcaacatatcacaggaattttcaatgaatatctcctgtcagtggtttcaaatactcacatcattttccagaaaagcaatgcttctttcacagagcattattgtagatacctcatgcatctatgtgtgatcataaaacacacgaaatggatggctgatccagggatatagaattcgttcctagtggctacagcttccactcttccacacaggcttttcattatcttggtcattagagaattacggcactatccaaagcagatgacaaaaatataaagatgcttaaacttaataatgtagaaaggtagttgaatattctcacatgctggggaattttttcatagaaaaagaaagatactatctttgcatgactatgtaaatattgacctaattggtggaaatgcacctgcacaagccccttattttatgaccaagaatacaaaatgtaccaacactaaaatttgttagtgaaagtttcctcgattatggtgaagcaaccataagtactttactgtgactgaggatttataagattcatgtgcccagctattaaggtttatacctaacaaggaaaatgctgaaatttaacttcatggaaaaaccaatgacagagctttctcacagaaagaagccaaactcttcagtctctcagtcattcaaatgtcattcaaatagcatacccctaagtccacttttttcctaattaaaagcatgtccctatatctctccccaatcccagtaaattgagaactttcacaatttttacaagaaatggaggatatggcaagaaaacatcacacatagaggactagataccaactgaagacatactctaccttaggcagaaatttatttcagatatctcttgggttattatatcaagaaaataattatcccatttatgtgtagacacaatctatgagttcgacatcatcactattttaaatgaaagaggcagtaaggtcattatagtttagttaatttgaatatttggaataaattcaaataacataatcttgttgaactctttttttccccttagaaaacctctagaggaaaaaaagacttgggtctccccaagaaagactagctaaatgccaggtaatgtgaaaaacctataatgtgaaaaatatattctaaagaaaattggacaataaattatgagcttcacattctgaaatactgaggtaagacaaatgatatttaagccagaatgaatgggaagctgttgtgggaagtcagggacactgaacagagtcaccagctggaatcacggcagaggaacataaattgtgaagttttcatggacatttgagttcccaaataatactcttataatttattatgtctgtctttactttaatctcttaatcttgttatcttcataagctgagaatgtacattacctcaggaccactattgtacaaattgattgtaaaacatgggtgtttgaacaatatgaaatcagtgcaccttgaaaatgaacagaataacagcaatttttgggaacaagggaagacaaccataaggtctgactgcctgcagggtcaggcacaatagagccatatttttcttcttgcagagagcctataaacagacataaaagtaggagagatatcactgaattcttttcccagcaaggaatactaataattcataccctaaggaaggaatgcattcctggggggagatctataaactgtcgctctgggagtgtctgtcttatgcagttgagataaggactgaaatatgccctggtctcctgcactaccctcaggcttactaggattggaaaattccagcctggtaaattttggtcagacgggttatctgctcttgaaccctgttttctgttgcttaaggtgtttatcaagacaatatgtgcacagccgaacatagacccacatcagtaattctaatttggtcctttgccttgtgatatttccttcaccctttgccttgtgatctttattgccctttaaagcatgtgatctttgtgacctactccttgtttgtacaccccaatcccctcttaaagtccttaataaaaaccttccggttttgtggctcaggcggacatcacggacctacagatatgtgatatcacccctggtggcccagccctaaaatttctctctttgtactctttttctttatttttcagaccagccaacacttagggaaaatagaaataacctgtgttgaaatattgggggcaggttcccctgacaggaagccccaggttctcttctctgagcatattcctagtgaggagggccttacccttactgttagaaggtccattcccaaaaagccttgaggctaagaagcagagagcctaagaaccgaagctgaccttctgattcttggcaaacagatcatcatagttctgcagttttaggttagagtacaggcttttgatcaaggcctgaatctatgttacatatgaccatagtgatctgaagtacattaattcaatcctttaattttattccaatatcaattcagtaactgtttctacaataaagaaatttgtattttcccacaacagagcagtgcctaagctcttcaattgttatttccatgacttagcttacaattggctctgttgaacatcttcatctcatcatatgtttaaatattggatattctgtgtcataagagccttagataagagtcccataaatacttatctgaacgagctaaggagcttatcatgtaacaggctccactaaatgttggtcattttcaacttacctaataaactgattgaatacatccatcccaaatgccatatatatgaattctaaaatatgaagactgtgtctataagtgctgtgctgtcttattggtaagtggtaaaagatgtacaaacatatctttaattctgaagaactatcagatatgatcaaagatatcatgatttaattatgactccaagatggtgaactaatatgaaaataagccataattctctgtgtcccttctatctgaattcaaataaccactaatgctttccacttttcagaatgacacaaaagtgtttgttagatcggatgatgcctacaatagcacagaatctgaatttatttgctccaataataaaaagtagacaaaaaatattaactaatgtagaagttgtcaaaaatttcccattgtccatacaaattttctgcaatccatacctattaccaagctagaaagttaaacataggtacagtatacactcattattttttaaaaaaagaaatgcatgtatattagtgcattctcacattcctataaggaaatacccaattctgggtaatttataaagaaaagaggtttaattgtctcacagttctgcatgattgggaaggcctcaggaaattacaatcatacctcttcacagggtggcaggagagagaatgagtgacagcagcagaaattccagacacttataaaaccatcagaagtcatgagaattcactcatgatcaagagaagagcatgggggaaaccacccccatgattcatttacctcctacctggtccctttcacaacacatgaggataatggagattaaaattcaagatgagatttgggtggggacacagccaaactatattagcatgttatgtagtccaaggtattgttaagactgaggatttcagggttcatggtggatgggagcatggactagattgcagctctggaatatatgtattaacagcatatccttcagtgcacgtagcatttgcttatccatgcaatgtctgcatattttcatgctcctgtgtggtaacctcaccatttggttaccataaaaaagaggcagaaaaaccactaatgaatggatatccaagaaattcggcaagagagaatgctattatggaaggtcataaaagtattctgagggaagttataagtgggcataggttccaacaaagaacccaggttttgactcataaaacaaagaaaatgcctctggcctaggattttcagatggtggccactttaatatatgcatgaataacatataatgatgagcagaataatgacatagcccagtaagccaaccaaaatgtggtgaagtataaagttctgtaaaactatgagcagtatttgctagggtcaaatattacaacacagtttcttggctatttcataggaccattagccatagatcctagtggtttcaactagacttatccttaaatggatgtttttctattttgtaattcacttagcctatgccccaagccacaagtgacaacactgtcaagctacagaaactctacataataccaatttgcccaacctagtacatctcatttatccaagatggagatttcctcatggcccatggacataaatgggctaaaaagtatgtcacatggacatattataccccttacaactcacataatagtgatgtaataaaagctaaaattgggtttaaaagagtaataagttattgaaaaaaatcatagcagatgggaaaggagcacaaagatggataataattcctagaaaggatatgattattattttcccatcagattatattgaatcttgagaataaaactgttaattgtttctctcatatatgacatgaagtcatttactgccgggaaatgatactagcctccttttcacatgagtgggagaacttaaattaaggtatttaacgctctgcttcagaattatattatttggaaaaaaattcccaatgcaataaatggctctgttgataaaactgaataaaaacaaatcataaatatgaataaatgaagatgataaaagataaagaaggaaatggagtagtccaaatgatatttaaaaaatgacatggtttgaatctgtgtccctacccaaatctcacgtagaaatgtaacccccaatgctggatgtagggccttgtgggaggtgactggattatggaggaagtttctcatgatttaacatcatccagttttgatactgtcatcacaatagcgggttctcataggatctggttttttagaagtgtgtggcaactccacttcttgctcctgctcctgccatgtaagatgtacctgctcccactttgccttccactatgattgtaaatttactgaggcctcctcagaagctgaggagatgccagcatcatgctttcagttacagcctgtagaaaaatgagctgattaaacttattttttaataaattacaaagtctctctgatatttctttatagcaatgcaagaatggactaatacaaaaaattagtaccaaagactgggaaatttctataaagataccagaaaatgtggaagcagctttggaattcggtaacaggcagagtctgaaagagtgtagaggacttagaagaagacagaaagatgagagagagtttggaacttcctagaaaagtttgaatggctgtgaccaaaattttgatagtgaagtgaatggtaaactctagactgaggaggtctcagaaagaaacaaaaaactaaatgggaactggatggaataagggtcatttttgccaagcttcagcaaagtctggctgcattgtgtcccttttctatggatccatcaaactttgaacttgagagtgatgatttagggtatctggcagaagaaatttctaaacagcacagcattcaagatttatcctggctgcttctaataacctaagctcatacaaatgagcaaagaaataacatgaaactggaacttatattcaagtggaaagcagagtgcaaaaggttgaaaatttgccacctggtcatttggttgaaaagaaaagcccattttctgggaagaaattcaagcaggctgcagaaatttgtataagtggaaccatgtgctaaccaacaaggcaatggggaaaagccctcaaaggcatttcagagatcttttcagcagcccctcccatcacaggccagaagacctaggagaagtgaacggttttctgggccagtcccaggaccctgttgccctcagcagccttgtgacactgttgtgtgtatcccagccatttcaggtccagctgtgactaaaaagggccaaagtacagttcagatgatgaaagctgtgaattttgaaggctttcatgtggtgttaagcctgcaggtgaacaaattgcaagagaggaggcttgggagcctccaaccaggattcagaggaggtatcaaaaagtctggaacttcagaccaaagcctgctgcatgggtggagaatcacagacaatctgtactaggacagtgcagagggaaaatgtgtggttggagcccacacacggagtacccacgggggcactgactagtggagctgtgagaagaggactaccatcctctagaccccaaaatggtagatccaccagaagcttgcaccctgcacctagaaaagccatgggccccctcaagagcaacaaaagacattaagagcaactgtgctgcccaaaccctataaagccacatgagtggaactacacaaggccttagaagactacccattgtaccagtatgccctggatgtgaggcatggagtcaaaggtaattgttttgtaacttcaagatttagtgaccactctgccagattacagatttccatggggcctgtaacccctttctttgtgctgatttctccattttggaatgaaagaatttacccaattcctatatcttctttgtatcttggaaataactaggttgcttttgattttacatgcttaggtgaaagggactaaccttgtctcagacgagactggactgtgcacttttcagtcaatgctggaatgggttaacactttgggggactgttgggaaggaatgattgtattttgaaagttgaggaaaagatgagattttagggaggtgaggagaagaatgatatggttttgatctctgtccctacccattaactggcctgacatctctactttctaccactgggatctctgaccaccatgtaaaacacctgactatacttttggttcttctggttcttcacctaaatggataggaagaaggacccagggatctttacagtcatctcttccaatatattataaatgtgaattaagttattctgcatcctacagactaccctgttagctgaataaggcagtgacttcagtcctatactccaaagcagaagaaataccaagccaacctgcctgaatttctggcacacaaaattttgaaataaaataaaatggtggtggttttaactcacaaaaactgtgaagccttgcaccatgcctgaagggaggaccagaaaaaaaagtggtacctcaaagtgtggtgattccataacaacaattcagtgtgtattgcattggctatagtgccaaaaaatagaagcctccagaatgttgtaagtggaggctgtaaagacagaagtaaatgttcttgaggaaagggaagagacttagtcactatccagtgctggaaacctttagtaattctgtcacctgtagtaaagtagaaaataaaaattgtacctaagagaatagggggttttggctaaaatttccaagtagaatatgataagttaccactgtttcttatagcaatgtatcttaccataaggcattagattttgttataaaaaataacaaaagattaactgttacactttcaaacagaatttacaagaaacatgaaagagccagaatttgccggtttcagaaacagaactagtttccctttccagtctctgcaaagagctaagtactctaaaggtaagaaaggtcatcaaaataaatgtcatttcaaagttgtggatgttaagaccctctcgtatatactttaaactagacaaacataattctaacattcttaagagtattagctcactgcacatagactttcagcccaagtctgagaagggccagtttcaaagatatttgtgagtatgctgcttgtgagtgtactaaagcaagcaccataggcttcacttgtgaacaggaggatctattttaattgcctggtcctctctttctccattatgtgctgggcatgtggaagaaatacactgtctcaatggatttgtaaatagagaaaaaccataatttaaaaagtgcacaatagacactgcacccaaggatcccatccacattcggtctggatatagaggttgagatcttgaatatcaaacagatgccatgatgggatgacatcttatttgagcggggagcttcaaaatcctgccttcccaaactaggaaatcttaattgaccttagaagtctaacaatctcacaggacagacgttgtctccatacacttctactaaaagaagagaaacactcattctaactatagttaagtttttaatgccagagtttttttacattggattttacagcaattctcatctctaaatttctcagtgtgtatattaatggattcaacatgtgtatgataactgtataaaacacagtcatgaatttatcaataggaaagttcgaaacaggtctaacgaaaaggaaaatacagggaacaagaaacaggacagtgactgttatgtaggagatgcaggcagacagggctttaagcctcccttcctgactataagttttaaagttgtttaggatgactccataggagattagtagaagggtgaagacgaccatacagattgctagaccattggcaacaacagtgagacctataaagtaggtatcagtgcaaaccagttccaataatgggtacatgtcacagacaaagtggtcagtgacatttggccacagaacgagagagtgtacacaacaacaatttgaaacacacaactcacaaaacctccagtcacagccaccaccaacagaaggatacaaacctgttgattcatgatggtcaaatagtgcagtggcttagagatggccacatagaaatcgtaggacatccccacaagtaggaagacctcagcaccaccaaataagtggtctataaatagctgccccatgcatgctgtgaagaaaatagtctttttatcatggagtaagcctataatcaatttgggagaaatggtattggaatatgcagcatatataaataacaggctgtgaggaagaagtacattggggagccaaaggaagggctggaaataatagccaccacagcaagcaagtttcccgccatactcacaacgtatgtgagtaaaaccatgacaaataatgcattttgcacatcaggacactgagtgttgcccaagaggacaaattctgtaacattattactcagtcccctttactcttctctaaggcttctgtcacagttgagagctcaggagaacaggacctgtaatgaaatagtgaacaggaatatgaatacatccatgatgtcacagagcacctcttcatcattttatcttcagtacagatttacacacacaataaactttttgtaagtttctattgagtttctcatcttctcaaagattttagtttgagcctacaggtaacagcttgtgcctctaagtttttgtgaatattctgtacagaagaagagttaaaggcccactagccattcatatatttcataactcctatttaaaacatatttcttggcatggaagtcagctatgatgaataggaaacagattattggtctcaagaaagttactttctcatggcggtaacagactttaaataaataagttggcatagattcagtactgtgagtttgtagttttggtatctttatgatctgtgtagcatcaaaaataacatcttctgaaatagctcactcagtactgtggcaatccacagttactcatttggtccttcatgcctcaaaaaatattcggtctttttgaatatctcattaaatgtcaaaagactggacattgacttgtacaaatagtaaaatattatttatcacgttgttccctatggcaacgatttggtctgaccctctgttgccttataacaagatatatgtctctatatcttatccttacttatttcacaaattttttgtcacatttacatacaatatcctggttttcaacaactaattttgaactcaagtaaactaattgatgaatatcaccaactgccacattagctgtgagtaattttttctgaattcttcaagtgaactacatagtgagggaggagaaaatatacactgtacaaagaggaacagaatggtggtacatggtttatttataacactatttagatatcaggagtactcacaaatagaaccttagtgttaagattccaaaaaaaaaaaaaagcatactcgaagagaaattccaactgcactgtaaggtaacatgaatttgagtcattttctgaatgcatttacaagtctgtcttcgtttgctcacaggaaaacaacatgattaaattagatgaagtgaaaatcctttctagtcaaccatctacaaaactattagtgcacctctcccttactctgttctgcagacttttttatttttcatatatttataattaaatagcaatttccaagctcatgactgttacattaataacggtagtcattgtagatgtttcatgattacagtgagtaaataatgactacaagtttctctttcaatatgtgcctaattaagtttcaagacatcattggagagaaggcatagcatgtggtgaataatgtggacaccagagccacactgcctctgcttcaacccctgcttcaccacttactatgtgtctttgggccacttactaagcctctctgtgcctcactttgatttaaaacctcttagggttgtcttatcacaacaaagtaaagtgcctagaacactggctggcatctggtaaaggctcaataagtgatggctattactcatgttcctgaaagcttcactgtgaacattggatcagaacgaatcatctggatctttgctaatttgaaaagactaatagacatagtcctgggaaaagaaaaaaaatacacctataattcaggaatggcttttggggaagacaatatatgtcttagtaactacctgtttaattatgtatgagtacttattttatctgtgatggaatgtatcttgaaaagatcaggaagaattatagtgaaaaagttggacccctcatcagaggtagagcgaaatggtagaaaatggaagaaaaaggagtcaagtcaagaaacacagtaattacaataagttaatatacacaggtaataagaagattaagattaatgtgataattgacgcaattattctcctaaaaatcttcataaagatttttagtgaggaaatactggaagcacaacctcctgtttgtccctggggtgactcaagaggcttcttggggtagccaaacacagaccaaattctagtgaataaaaaaaagaaaaagaaagaaaactcagaagaaaaacagaacacactgatttctcaaagtctctaggtcagatagataaggacaaatttaaattacagagaacaatgggacaagtagaaatacaaacccaaacttcctgattactcactgatgaggaaaatggcaaaattactaaacctcaagtgtagacaagatgattccatttgcatagatctggcagtggaagaggatgtgtacagagagagtttgagctgtctctagaagccagagtgatgaacattccacatgtctaattcacattacctctttcagttgattccagagttctgtcactgttgaagctgtagactgatagagacatatctgctgaagaacaaaagggaataatatagcctatagccaattctgttatttttccacaccttacttcctgcaaggtttactgtcttttccctcttccatcttcaaaactagacttcaacaacaggataattctatttggcaatttaaatgtctacttgtaaaaacataaggtatgtaacctatcctctatagtttaagtaattaaatatggaatactttagaaactgaaagacagcattactaggctttcaatggaaaccgttaacatatttctagaaaaaatgatttaacagtgtttcctaagaacatgccagttttaaaagataaaattccataacaaaaaacttctataatattacatttcacagtcacagttatataaatctatttaaatgacagtagactaagtactttcctcagcatatttatctactagtatgattgctgggataatttttagattcataagtaaaaacccatattatgcttccagaacataacaggcattggttccttcacaatcaaacacgtttgacatgatctgcaattttaaactccataatcaaaaatatttgagtaattgttcacctttattaatacggtatataaaatattccataacctaagattatgattataaatttattggtttattatacatgtaatatggaacatgtttttcttcctatttggcagaatggaaaaagaaaaccaatttggctgtatattaaaaccaaatatacattatatattctgataaatttccatgtttgttggcttaattttcccaattagaatttatccaatgaagtcatgtggtatttatgacattacctgtacttcaacatatcacagaaatttgcaatgaatatctcttgtcaatggtttcaaatactcacattttggtccagaaaagcaatgtttctttcattgagggttactgtagatacctaatgcatctatgtgtgatcataaaacacatgagtataaatggctgatccatggatatagaattagttcctagtggctacagtttccacagttccacacaggcctctcattatctcagtctttagaggagtatagcactatccaaagcagatgaccaaaatattaaaatgcttaaacataatgtcaaattttattctacaaatgtagttgaatgctcttacctgctgaaaaatttcttcataaaaaacaaagatcctaaatttgcatgactatatacaaattgacatacttagtagaaattaacaaagatgagtccattattatttagtggcaaaagtatcaacactacaatttgttacttgaaagttttcttaattatggtgaagcaaccagaagcactttactatgattgaggatttgtgataacattcagggtccagctactaacctttgtacctatcaagaaaaatgctgagattcaacttcatggaaaaacaaatgacagagccttcccataggcagaagccaaacatttcaatctttcagtcattcaactagcatatccctaagatcacttctttcctaagtgaaaccatgtctcttcatctccccaatctcatcccaggaagttgagaactttcacacatttttacaagcaatggtgggtatgacaaaaaaaaaaaattacacctagaggactagataccaactgaagacatacgctatctggagcaaaaaaatcactttttcaatatcttcagggatattctagcaggtaaataattcatccatttatgtgtgtagacacagtctatgacttttacatcaacaatattttaaatggaagggactgtaaggtcattatagatttgttaattagaatatttggaaaatgtaaagcacccaattctgtcactgtttgtggcaccacttgtaacctgctacaatccctggtggactgaacaaagggggtgaaggcgggaataaaagcaaagagacaaagagtatatttggaagaaggggtcgggggcatcttgcctctagtgaaaaagggtcctgagctttacacaaccctccatatttattaggcaaaagagatagcgaggagggcgagtagttgtcagataactgtcagtccaccctttggttcacagcaggcttgcgaggctgtattccaggaacaattggtgctagatgtctcaggaaataacttcaaggagcccagtgccaggaggtgatggccctcagcaaaccttctggtggcaggcacagatgtgagtttgcccacatcctgcattcatggtaaacagtttgctgtttgatcatatagcctccagtggaatgctgagctggtcacaatgcctctgctggctctctacatctccccgtttctgtttatggattaattaaaagaatataaggccaggctgggcagatctcattttctgtttagtggtccatctgattttacagactatgaacagaagacagagacaaaacaacattattccaagaactacatataagatgttaatgtggtgccttaaataggtccaagggttgaggctctccaggccttgctggaattcggtccagtcttctaaggctgaaattcttgagtttccctatttaaatcaagaattttgttttgtaattcactgatatcaaagatgatattggatgtgaaagctcccttcaatgggctttcacacagtgccatggtgccatggatactcactttggttatattctaagttggttacacaaatgtgagtgtggttacaatggcgacagaattgctgctgcaactgcaggctttgtacttgttcctctaatcataggactgtggatttcaacattgcaacttcagtttgtaactcaggattaattttattctggccatgatacctgctggactaaacaaagacaaagaaaaaagaaaatatatttggaagaaggggtcagagggcaccttacctctagtaaacaagggccctgagctatacacagccctccgtatttaccaggcaaaagaaatagccaggaggggtgggtagttttcaggcaattgtcagtcatccatttggttcacaacaattggtgttaaatgtctcaggagataacttcaaggagccctgtgccaggaagtgatggccctcaacaaaccttttggcagcaggcacagtgtgagtttgctcacatcctgcattcatgataaacagtttgcattcatgataaacagatatattcatatagcccccagtggaatgctgagctggtcacaatccctttaccggctctctgcaggaacaaattcaaatgaagtaatctctctgaaaacctttttttctaagaaaatccctagaagaaaaagacttggctcttgctaaggaaaagtagctaaatgccaaataatttgaaaagcctgtaatatgacaagaaaaactcaaaagtaaattgaatagtaaattatgagttttacattatgaaatatttaggtgagacaagtaatatttcagccagaatgaaaggagatcgagccccaggctctcatctttaaaaatgttcccagtaaggagagcctcacccatcccgttaaaaagtctgtgcccaagaaaccctgaggctcagaggcagagagcctaagaacagaagttgacattctgattcttggaaagataggtaatcatagtgctgcagtttaattagagtacaggcttttgatcaagacctgaaactatgtcagataaaatcataatgatctgcactccattaattcaatcctttaattttattccaatattaattcaataacagtatctacaatacagaaatttgtatttgccaacaagtgagtagtgcttaagggcttccactgttatttccatgacttggcttaccattggctccatggaacaccttcatctcatcatatgttaattaaatattggtgtgatagaagccttagataaagagtcccataaatacccatctgagccagcaaagatgtttatcacataatgagctccactaaaagttggtcattttcaacttacttaatacatgttttaaattcatccaccccaaatataacatgtattattattgctaaaacttgaagagcatatctatcaacattgtgctctcttactagtaagtggtaaagcatgcacaaacatatgtttaattctggggaactatcagatatgatcaaagatactgtggtttaaattatgactccaagatgaagaactaatatatgaaaacaagacctaattctctatgtcccttccaacagaattcaaataactactaataccaacacccactgtggaaataaatccttcctcagccaagccttcatatgagatggtagacccaaccagcaccttgattacagttttgtgagagaccttgaagcacgggaacctgccaaaccacactgtttcctcacctacagaaattgagaatgagtacaaattgtttgaatcactaagttttgaaatattttgctatgaataaatatgtaactcataaatgtatctagaatatacttcaaatactgggaaacatgccaataaatatttagtgaacttatgaatcaaagaaaaagatataatgaagctaagcaaataaaactaagcaataacagaaacatatcaaaatgtgtgaggtttgatcaaaacagtacttaaagaaaaatgtatagctataaatgcttacatttaaaataaatgtttaaaagcagccattcaatccttcaccttaagaagctagaagaagagtaaataaaagccaaggtaagtaaaaaaaggacataaacataagatcaaaaaccaataaaatggaaaacataaaatagagaaaataaaaatagccaaaattcgtacttttataatcaaattgataaactgtcagcaaggggagatcaagagaaaacaaagagaaatccaaattaccaatatcagaaataataaaacaaataatcatcccatagttcctttaggcgttaaaaggttagaaaatgatagttatgaaacgcattatttctttttttttttaagtttcaaaacgtttatttatttattatactttaagttctgggatacatgtgcagaacgtgtaggtttattacataggtatacacatgccatggtggtttgctgcacccatcaccctgtcatctatattaggtatttctcctaatgttatccctcccctagcccccagcccccctgacaggaccctgtgtgtgatgttcccctccccaggtccatgtgttctcattgttcaactttcacctatgagtgagaacatgcggtgtttggttttctgttcttgtgttagtttgttgagaatgatggtttccaacttcacccatgtccctacaaaggacatgaactcatccctttaatggctgcatagtattccatggtgtatatttgccacattttctttatccaggctatcaccgataagcagtagggctggttccaagtctttgctattgtgaacagtgtcgcaataaacatacatgcgcatgtatctttatagaatgatttataatcctttgggtatatagccagtaatgggattgctgggtcaaatggtatttctggttctagatccctgaggaatcaccacactgtcctccgcaatggttgaacaaatttacactcccactgacagtgtaaaagtgttcctatttctccacatcttctccagcatctgttgtttcctgactttttaatgatgggcattctaactggtgtgagatagtatctcattgtggttttgatttgcatttctctaatgaacagcgattaggaggtttttttcatgtgtttgttggccacataaatgtcttcttttgagaagtgtctgttcatatatccttcacctactttttgatggggttgttttttattttattttattttattttatttattttattttattacactttaagtttttgggtacatgtgcacaatgtgcaggtttgttacatatgtatatatgagtcatgttggtgtgctgcacccattaactcatcatttagcattaggtatatctctaaatgctatccatcccccctccccccaccccacaacagtctccagagaccgatgttccccttcctgtgtccatgtgttctcattgttcaattcccacctatgagtgggaacatgtggtgtttgggtttttgcctttgggatagtttgctgagaatgatggtttccagtttcatccatgtccctacaaaggacatgaattcatcattttttatggctgcataggattccatcgtgtatatgtgccacattttcttaatccagtctattgttgttggacatttgggttggtttcaagtctttgctattgtgaatagtgccacaataaacatacgtgtgcatgtgtctttatagcagcatgatttataatcctttgggtatatacccagtaatgcattatttcaattaattggacagcttagatgaattgggtagaatgtagggaaaggacaaccttctgaaaatgacacaaacagaaactgacacactcctatctctttccaagtaatgaactaaccttacctgtagaaaatatgatagtgtttcagaaaaccctaaagaatctacagacataattgaacatagttaaatttcccttataaatactagcaacaaggacattggaatttttttttaatgaaaaacctttgatgaaatctgaaaacataaacacttaggaatagataaggaagatccataataaaaactacaaaactctccaaaaataatcatttaaaatacgtaacagatatattgtattcaggaattagaaaacccactattgttaagatattattagtacaagatgatttatggatccaacttgaataaaactccaacatgctccttttgagatgtagacaattgttctgcatgctgctctgtgaaatgattttaccacttcccactcaagggttatcatctatttctgtaaaacatcaaatctggggtggtcatgtgaccactcgtttgaatagaatatgatgcaagtgacattgcaccagttatggacatagcacttacctggccaaactcatctatgttctaccactgcgatctctgagcaccatacaaaaagtgtggctattctctggagtgatctcgtggtcctttatctaaagagataggagaaggaacacagtgcatctcttaatgtcatcccttctaatatactataaatgtgaattaagttatcctgcctcttacggaacatttagttatcaggtgaataagagagtgacttcactccttgccacacaaaacagaagaagcaccctgccaacaactgcctgaattcctggctcacaaaattttgatataaaatgaaatgatggttgtttaactcacaaaaactgtggaaccctgaacattacatgaagacagaaccagaataaaagtgacatctcaaggcgtggagtttccataactacaatttaaagtgtatggaattggctttagtgtccaaaaataggggccaccaggacactgtaagtgaatgctcaaaagacagaagtaactattccagaagctgtgaaaatttgacttgtgatgcaatgctgaaaaaatttagtacctctgtcacccataggaaggtagaaaatgaaaaatatacataagtaaattggtggatatggctaaaatttccaagtagaatactgaaaatttcagctgtttcttacagcagtgtatcatataataaggcatagatatttaaaaaacactaatgaggggtggagcaaagatggccgaataggaacagctccagtccacagctcccagcatgagcgatgcagaagactggtgatttctgaatgcccaactgaggtaccggattcatctctctggggagtgttggaaagtgggtgcagtgtagtgggtgcagtgcaccgagcatgagccgaagcagggcgaggtaacacctcacctgggaagtgcaaggggtcagggaattccctctcctagtcaaagaaaggggtgacagatgacacctggaaaatgagatcactcccaccctaatactgcacttttccaacagtcatagcaaatggcacaccaggagattttatcctgcacatggcttggggggtcctaagcccatggagccttgctcattgctagcacagcagtctgagatcaaactgcaaggcagcagcaaggctggggtaggggcacccgccattgccaagccttgagtaggtaaacaaagcggcctggaagcttgaactaggtggaacccaccgcagctcaaggaggcctgcctgtgtctctagacaccacctctgggggcagagcattgccaaataaaaggcagcagaatcctctgcagatttaaatgtctctgtctgacagctttgaaggagtagtggttctcccagcatgcagctggagatctaagaacagacagactgcctcctcaatgagtccctgaccctcgagtagcctaactgggaggcatccccaaatagaggcagactgacacctcacacggccgggtactcctctgagacaaaacttccagaggaatgatcaggcagcagcacttgctgttcaccaaaatccactgttctgcagcctccgctgctgatacccaggtaaacagggtctggagtggacctccagcaaactccaacacacctgcagctgagggacctgactgttaaaaggaaaactaacaaatacaaaggacatcgaaaccaaaacaccaactgaatgtcaccatcatcaatgatctaatgtagataaaaccacaaagatggggaaaaaaagagcagaaaaactggaaactctaaaaatcagagcacctctcctcctccaaaggaatgcagctcctcaccagcaatggaacaaagctggatggagaatgactttgacgaattgagagaagaaggcttcagaccatcaaactactctgagctaaaggaggaatttcaaaaccatggcaaagaagttaaaaaccttgaaaaaaaaattagacgaatggctgactagaataaccaatgcagagaagtccttaaaagacctgatggagctgaaaaccaaggcatgaggactacgtgacaaatgcacaagcctcagtacctgattcaatcaactggaagaaagggtatcagtgatggaagataaaatgaatgaaatgaagcaagagagaagtctagagaaaaaagaataaaaataaatgaagcctccaagaaatatgggattatgtgaaaagaccaaatctacttttgattggtgtacctcagagtgacggggagaatggaaccaagttggaaaacactctgcaggatactatccaggagaaattccccaatctagaaaggcaggccaacattcacattcaggaaatacagagaaccccccaaagatactcctcaagaacagcaactccaagaaacataattgtcagattcaccaaagttgaaatgaaggagaaaatgttaagggcagccacagagaaaggtcgggttacccacaaagggaagcccatcagactaactactgatctctcagcagaaactctacaagccagaagagagtgggggccaatattcaacaggcttaaagaaaagaattttcaactcagaatttcatatccagccaaactaagctttataagtgaaggagaaataaaatcctttacagacaagcaaatgctgagagattctgtcaccaccaggcctgccataaaagacctcctgaaggaagcaataaacacggaaaggaacaaccagtaccagccactgcaaaaacatgccaaatcgtaaagaccattgaggctaggaaaaaactgcatcaactgactagcaaaataactagctaagagcataatgacaggatcaaattcacacataacaatattaactttaaatgtaaatggtctaagtgctccaattaaaagacacagactgacaaattgaataaagagtcaagacccatcattgtgctgtattcaggaaatcaatctcacatgcagagacacacataggctcaaaataaaaggatggaagaagatctaccaagcaaatggaaaacaaaaatccaggggttgcaatcctagtttctgataaaacagactttaaaccaacaaagatcaaaagagacaaagaaggccattacataatggtaaagggatcaattcaacaagaagagctaactatcctaaatatgtatgcacccaatacagaagcacccagattcataaagccaatccttagagacctagaaagagactcaaactcccacacaataataatgggagactttaactccccactgtcaccattagacagatcaatcagacagaaagttaacaaggatatccaggaattgaactcagctctacaccaaggagacctaatagacatctacagaactctccaccacaaatcaacagaatatacattcttctcagcaccacaccacacctattccaaaagtgaccacatagttggaagtgaagcactcctcagcaaatgtaaaagaacagaaattattataaactgtgtctcagaccacagtgcaatcaaactagaactcaggattaagaaactcactaaaaaccgctcaactagatggaaactgaacaacctgctgctgaatgactactgggtaaataatgaaatgaaggcagaaataaagatgttccttgaaaccaatgaaaacaaagacacagcataccagaatctctgggacacattcaaagcagtgtgtagagggaaatttacagcactacatgcccacaagagaaatcaggaaacatctaaaattggcaccctaacatcacaattaaaagagctagaaaggcaagggcaaacacattcaaagccagcagaaggcaaaaaataactaagatcagagcagaactgaaggacacagcgacacaaaaacccttcaaaaaatcaatgaatccaggagctggttttttgaaaagatcaacaaaattgatagaccactagcaagactaataaagaagaaaagagagaagaatcaaatagacgcaataaaaaatgataaaggggatattatcaatgatcccacagaaatacaagctaccatcagacaatactataaacacctctacgcaaataaactagaaaatctaggagaaatggacaaattcctgggcacatacaccctcccaagactaaaccaggaagaagatgaatctctgaatagaccaataacaggctctgaaatagaggcaataattaatagcttaacaaccaaaaaaagtccaggaccagacggattcacagccgaaatctaccagagatacagggaggagctggtactattccttctgaaactattccaatcaacagaaaaagagagaatcctacctaactcattttatgaggtcagcatcatcctgataccaaagcctggcagagacacaaccaaaaaagagaattttagaccaatatccctgatgaacattgatgcaaaaatcctcaataaaatactggcaaaccgaatccagaagcacatcaaaaagcttatccaccatgatcaagtgggcttcatccctgggatgcaaggctggttcaacatacccaaattaataaatgtaatccagcatataaacagaaccaaggaaaaacaccatatgattatctcaatagatgcagaaaaggcctttgtcaaaattcaactacccttcatgctaaaaattctcgataaattaagtattgatgggacatatctcaaaataataagaactatctatgacaatcccacagccaatatcatattgaatgggcaaaacctggaagcattccctttgacaactggacaagacagggattccctctctcaccactcctattcaacatagtgttggaagttctggccagggcaataggcaggaaaaagaaataaagggtattcagttaggaaaagaggaagtcaaattttccctgtcacagatgacatgattgtatatctagaaaaccccatcgtctcagcccaaaatctccttaagctgataggtaacttcagcaaagtctcaggatacaaaatcaatatgcaaaaatcacaagcattcttatacaccaataacagacaaacagagagacaaatcatgagtgaactcccattcacaattgcttcaaagagaataaaatacctagaaatccaacttacaagggatgtgaaggacctcttcaaggagaactacaaaccactgctcaatgaaatagaagaggatacaaacaaatggaagaacattcgaatctcatgggtaggaagaatcaatatcgtgaaaatggccatagtgcccaaggtaatttataaattcaataccatcctcatcaagctaccaatgactatcttcacagaattggaaaaaaactactttaaagttcacatggaaccaaaaaagagcccgcattgccaagtcaatgctaagctaaaagatcaaagctggaagaatcacgctacctgacttcaaactatactacaagtctacagtaaccaaaacagcactgtactggtaccaaaacagagatgtagaccaatggaacagaacagagccctcagaaataatgccacgtatctacaacaatctgatctttgacaaagctgacaaaaacaagaaatggagaaatgattccctatttaataaattgtgctgggaaaactggctagccatatggagaaagctgaaactggatcccttccttacaacttatacaaaaattaattcaagatggattaaagacttcaatgttagacctaaaaccatcaaaaccctagaagaaaacctaggcaatatcactcaggacataggcatgggcaaggacttcatgtctaaaacaccaaaagcaatggcaacaaaagccaaaattgacaaatgggatctaattaaactaaagagcttctgcacagcaaaggaaactaccatcagagtgaacaggcaacctacagaatgggagaacatttttccaacctactcatctgacaaagggctaatatccagaatctacaatgaacccagacaaatttacaagaaaaaaacaaacaaccccatcaaaaagcgggcaaaggttatgaacagatacttttcaaaagaagacgtttatgcagacaaagacacgtgagaaaatgctcatcatcactggccatcagagaaatgcaaatcaaaaccacaatgagataccatctcacaccagttagaatggcgatcattaaaaagtcaggaaacaacaggtgctggagaggttgtggagaagtaggaacacttttacacttttggtgggactgtaaactagttcaaccattgtggaagtcagtgtgacgattcctcagggatttagagctagaaataccatttgactcaaccatcccattactgggtatatacccaaaggattataaatcatgctgctatgaagacacatgcacacgcatgtttattgtggcactattcacaatagcaaagacggaaccaagccaaatgtccaacaatgatagactggattaagaaaacgtagcacgtatacaccatggaatactatgcagccataaaaaaggatgagttcatgtcctttgtagggacatggatgaagctggaaaccatcattctcagcaaactattgcaaggacgaaaaaccaaacaccacactgtctcactcataggtgggaattgaacaatgagaacacatggacacaggaaggggaacatcacacaccggggactgttatgggatggagggagtggggagggataccattagggatatacctaatgttaaatgacgagttaatgggtgcagcacaccaatggtgcatgtatacatatgtaccaaacatgcacattgtgcacatgtaccctaaaacttaaagtataaaaaaataaataaataaataaagaacaccagtgaaaagattaaccattacatattcgacataatttacaagaaacataaaagaacaagaaattgttggtttcaaacataaaagtggttcccctttccactgtctgcaagagctaagtactctaaacccaagaaaggtcatcaaaataaatgtcatttgaaagttatggatgttatgacacttagaaagactacagaaaaatttaacggtgtgtctcataagtaccttaaactagagaatcataattctaagattcttaaagtgttatatgactgcatatagagtttcagcccaagtctgggatggaccagtttcaaagatatttttgagtatggtccttgtatattccacaaaatctttaaaaacttacactaagggaagcatcacagccttcccttctgaacaggggcatccattttattacctattcctctctttctccattgtgtgctgagaatgtggaggaaataccctgtctcaaagatctgtaaatagtaaaagccataatttaaaatgtgcacagtaaaacccgcccccaaggagccccatccacactcagtctcgatgtagaagttgagatcttgaacttcaatcagatgtcatgatgggatgactttgtaattgagctaggagcatccaaatcctgtcttctttctttgggatccttgacttgcccttagaaacctgaaaacttcactgggaagaccttgactacatacctccttacctacatgaggacggacactcctcctataataaatatagttaactttttacccaagagtttttctatagcatttctcatctctgaatttctcaacgtatatattaaaggactcagcatgtgtgtgataatggtataaaacacagtcatgaacttatcagtaggaaagtttgaaacaggtctaacatatatgaaaatacagggtacaaaaaagaggacaacaacggtactgccggagctgcaggtagacaaggctttacccctcttttcctgactgtaagttttaagggagcttaggatgactccataggagattaacagaaggttgaaaatgaccatacagattgctccactattgacaacaacagtgaggcctataaagtaggtgtcagtgcatgccagttccagtaatgggtgcatgtcacaactgaaatgaacaatgacattgggaccacagaaagggagactgtacacaacaatttgaaacgcagaatgtacaaaacctccaatcatggccaccaccaacagaaggaagcaaacctgtcgattcatgatggtcaaatagtgcagtggcttacagatggccacatagcgatcacaggccatcaccaccagaaggaagacctcagccccaccaaagaaatggtctataaatagctggcccatgcaaccttggaaggaaatagtctttttatcacagaataagcctacaattaacttgggagaaatggtagtggaatatgcagcatctataaatgacaggcaggcaaggaagaaatacattggggaacccaaggaagggctggcaataatatccaccacaatgagcaggttccccaccactgtcaccaagtatgtgagtaaaaacatgacaaataatgctttttgcacaccaggatcctgagaaaagcccaggaggacaaattctgtaatattgttattctgtctcatttactcttctttaaggcttgtatcagaggtgagagctcagggaaacagggcctgtaacgaaatagtgatcaggaatatgattacatccattgtgtcacagggcacatcttcattgctgtatcctgaatagtgatttacacataataaatatttagtaagtctctattgagttcctcacccaaagagcccatcttgccctgatgattctatttctcctcaaatattttagtttcagtgcacaggtaaaggcttctacctctaagttttagtgaatattctatatagaagaacagttaaagtcccaacagccatttgtacatttcataatttctgatttaaaacattttattggcatggaagtcagctgtgatgaataggcaatgggtccttcatctcaagaaacttactctctggtggtggtaataaactctaaataaataaattgacatagatttagtcctttatgtttgtacttgtggtatctttgtaatataatctgtatagcaccaagaataatctcttctggaatatctcactcagtactctgaccttctactgctagaacttcattccttcatgcctcaaaggatgttcattagtctttcattaaatgtcaaaagacaagactctgaactgtataaatgctatgacattatttatcacattgttccttgtagcaattacttgatgtgactctctgttctctttataaggatctgtgattctgtccattttatccttgcctgtacacaaatttttacaacacatatatacaatatcctaattttcagcaattaattttgaactcaagtgaactaactcatgactgtcactaactaccgaataagcagttagtacttttttctgaattcttgggaggagctagttagtgagatagaagaaaatagacactgtagaaagagggacatggttttattcataacacaatttagataccaagagtactcaaaaatgtaatcttagttacaagatttcaaaaagaatcatactctaagagaaattccaagttcagtgtaagaaggcacggatttgattctgaatacatttacaagtctgcctcagtttgctcactggaaaacaatgggattaaatttgagaaattcagaatcctttctagtcaattatctacagaactattcatgcacctctcttttatgatattctgctgacaatttgtttttcattttttataaatttataattaaataaaaatttccaagctcatgacgtttacatgaaaaatggtagtcagtgggacatggggtttcatgattacagtgaataaatagtgactatacgtgtctcattcagcatgtacctatttaagatccaagacatctttggagagaaagtgtagcatgtggtgaataatgtggacactggagccacactgcttcagctacaacctcaagttcaccactttttatgagagtttgggccatttactaaagctctctatcccttacttgcatcatttttaaaatgaggagtccaacaacccttacctattagagttgtcgttttattaaaacaaagtaaagtgcctagaacactggctggcacctgggaaggactcaataaatgatagctattattactgtttttgaatgcttcactgtgaacacagaatcagaacaaattattcagatctctgtcaacttgaaaagatttatagacgtagtccaggaaaaaaaaaggataagatacgtacaattcaggaaagcctgttatggccaaacaataaaactctatgtcttagaaaataatgatttaattatgtgagtagtaattttacctgtgatggaacgtatcttagtgaaaagcaagcagaagtatagtaaaaatttggacccaccatcagagggagctcagggaatgaaaagaagactaaaataagaaaacagagaaatcatagttaacaaatgagtatccacaagcaataagaaggttaatgggacaattaagtaattaagtgagattattattcttttaaaattctcttcagaaagattccttttagtgagaaaatgctggaagtgaaacctcctgtcggtccgtggggtgactcaggaggctttttggggtagatgtaacaaaaacaaaccagatactagtaaaagaaaagaaaagaaaagaaaagaaaagaaaagaaaagaaaaaagaaaagaaaagaaaagaaaaacacgcattgttactcttaagtctctagtactgatggttaaggacaaaccaattacagagaacaatgggacaagtagagatacaaacccagactttctgattcttcactgctgaggaaagctgcagaattactaaacctcaaatgtagacaggatggttccatttacatagatctggtagtggaagaggaggtgtgcagagagagtttgggctgtctctagaagtcagctgtgatgaacattccacatgccccacgttaccatttccagctgattccagagttctgtcattgttgaagctatagactgacagagaggcaactgctgaagaacacaagggaataatgtagtctatagccaattctgttatttttttcacaccttacttgctgcaaggtttagtgccttttccctcttccatcatgaaaactagatttcaacaggataatcctttggcaatttaaatgtttacttgtaaaaaatagggtgagtaaaccgtcctctgtagtttaagtaagtaattacaaatggaatactttagaaactgaaagataggattacaagactttcaatgtaaactgctaagttaaagtttttctagaaaaacatgatttaacatagtttcctaagaacatgatattttcaaaagataaaatcccataataacagaaaacctctataatattatatttcacaatcatagttttataaatctatttaaatgacagtagactagatactttcctcagcatatttatctactagtatgtttgctgggattttttagattcgtaagtaaaaacccatattatgcttccagaacataacaggcattggttccttcacactctaacacacttgacatgatctgcaattttaaactccctaatcaaatatatctgaaagtaattgtacacttttattaatatatcatataaaatacaacatctcaaaaattaagattataattataaatctattggtttattaagcatgtagtatggaactttttttttatttaacaaatagaaaagaagaaaaataaattaggctatatattaaaaccaaatatacattgtatgttccaaaaagttttcatgtttcctggctaactttcccaattaaattccttcaacaatatcatatggtatttaagatattagctacatttcctcatatcacaagaattttcaatgaatatctcctgtcactggtttcaaatgctcacactgtaatccagaaaagcaatgcttctttcactgagtgttaatgtagacatctcatgcacctatttgtgatcacagaacatgtaaatatgaatgactgatccagggttagagaactagtttctaatggctacagtttccacaattccacacaggattctcattatctcagttgttacagaggtatggaaatatccaaagcagatgaccaaaatataaagaggcttaaacataatacacaaaggtagttaaataatctcacctgctggaaaatttcttcataaaaaaccaaaaatattatcattgcatgactatgtaaaaattgacctaattaatgaaaattaacctggacaagacccttattttgtgacacaagtgaacaaaaatataccaacactaaaatttgttacatgaaagtttcctcaattatggtgaagtaaccataagtactttactgtgattgaggatttatgataacattcatgtgcccagctattaagctttgtacctaacaaggacaatgctgaaatttaactttatggaaaaaacaatgacagaactttctcacaggcagaagccaaactcttcagtttttcggtcattcagatataattccaatagcgtacccctaaatctacttctttcctaattaaaatcatgtctttatatctccccacctcagcccagtacattgagaactttaacaaatttttacacaacatggaggatatgacaagaaaacaccacacctaaaggactagataccaaatgaagacatgctctaccttgggtagaaatttaactcttcagatatctcttgggttattctatcaggaaaataatatttccatttatgtgtgtagacacaatctatgacttttgcatcatcgtattttaaataaaagagagtgtaaggtcattataggttagttaatttcattatttggaataaattcaaatgaagtaaactctccgaacatctttttttccccctagaaactccctagagggaaaagatttgggcatcaccaaggaagagtagctaaatgccaagtaatgtgaaaagcctataatgtgaaaagaaaaattttaaaataaattgaacaaaaattatgagtttcactttatgaaatactgaggtaaggcaagtaatatttaagccagaatgaagggggaaccagtcccaggttctttaccctaagcacattcccaaaaagaagggctttacatttcctgttagaaattccatgcccaagaagtcctgaggctcagaggcaggcagcctaagaacagaatttgacattctgattcttgaaaaagcaggtaatcatagttctgcagttttagatcagagtaaaggcttttgatcaaggcctgaatctatgtcagatataaccataatgatctatagtccattaattcagttacttaataattgtattccaacatcaattcagtaactgtttctacaataaagaaatttgtatttttcaacaagggagcaatgcttaagggcttccattgttatttccgtgacttggcttaccattggctccattgaacacgttcatctcatcatatgtttagttaaatattggatcttctgtgtcataagagtgttagatacagagtcccataaatacatatctgaaccagctaatgagtttatcatgtattgggctccactaaaagttggtcattttcaacttacctaatacatggatgaaattcatccacaccaaatgtaatctgtatcacttctaaaatttaaagactatgtctgtaagcactgcgctctcttacttgtaagtggtaaaagatgcacaaacgtataattctgaagaactatcagatatgatcaaagataccatggattaaattatgactccaagatggacaactaatatgaaaataaaccaaaattctgtatgtcccttctagctgaattcaaataaccactaattcttcccacttttcagaatgacacaaaagtgtttgttagatcagatgatgcaggagggagaagaagcgacagcaggagaaatgacagacacttatgaaaccatcagatctcattagaactcactcatgatcaagagaacaacatgggggaaaccacctcataattcaaataccctccacctagttccttccacaacacatggggataatggggactacaattcaatatgagatttgggcacaggcaaagccaaactatatcagcatgttaggtactgccaggtatttttaatactgaggatttcagggatcatggtggataggaggcaggactagattgcagctctggaaagagcagcttacggaggcttgcactgtgaattttagctccagaatgactacaacaacacaccagtcatcctgagaggacccacaaaccctctgaaagaagcagactgctcctgcaggacccaggagacacctcaaatactgtgagtgccgtaattggagaagtgggaaacggagaccctcctctcccgaacacacacctgcactagagaagctgaaggtcggtttgcaggagaaattcctgactttacctggagctgagtcaagttagagagccaagccaagaaaaatacaggggtagaggaaacagcagaaaggccctgggggctcactggatccccaagcagcccattcctgtctggcaccacagggatccatcaggagggtggccagaggagcaagcagtgaaactccccagagagaaggacttctcaagctgaactttgtaactatttgaatgggatgagaaacctcctggccagaactcgggggagggctcaaatctggtatgcagacttcacaggtcagggaagaaataaatccctttttttccacacctgagagacagaaagccttgggcaagttttcaagccctacttgccctccacctagaaacagactcagattactatgggggacacggtgtgagtgagacctctccttctgtttgcatgggaactgggtgaggcccatgactgcttgctttcccacacttccctgacatcctgcaggactcagcagaggcacccataatcttcctaggtacacaaaccaatgacctcagaatatcacacccatcccccacagcagccacagccagacccaccaaaggagagtctgagctcagacatgcctagccccacccccaaatgatggtccttccctatccacactggtagcggaagacaaagggcatataatcttgggagttctagggcctcacccacagcctttccctttccacaatactacagctgatgctttctggaaagtgccacctcctggcagaggccaacaagcacaaaaatagagcattaaaccaccaaatctaaggagccctatggagtccattgcaccctccgccacctccactggaacaggcgctggtatccatggctgagagatccatagatggttcattcacacaactctgcagacaacctcagtgcaagcccagagcagggtagactctctgggtggctacacccagatgagagacaaacatcactgtagattggctcacaagaagcaacatccacaggaaaacgtgaaaaatactacatcaagggaacacctcctgggacaaaaaaaattctgaatgacggcctccagccctagaccttccatctggcagagcttacgccaatgagaaggaaccagaaaaccaaccctggtaatatgagaaaacaaggatcttcaacacccccaaaaaatcacactagttcaccagcaattaatccaaaccaagaagaaatccctgattttcctgaaaaagaattcaggaggttagttattaagcaaattagggagggaccagagaaaggtgaagcccaatgcaaggaaatccaaaatgggatacaagaagtgaatggagaaatattcaaagaaatatatagcttaaagaaaaaaacattcaaaaattcaggaaactttggacacactgttaaaaatgtaaaatgctctagaaatactcagaaatagaattgaacaagtagaagaaagaaattcagagctcgaagacaaggtgtttgaattaacctaatccaactgagacaaagaaaaatgaataagaaaatatgagcaaagcccccaagaagtcttgaacttcattaaatggccaaaccaaataataatcagtgttcctgaggaaaaagaaaattctaaaaacttgggaaacatctttgggaaaataatagaggaaaacttccccagccttgctagagacctagacatccaagtacaagaagcaaaaagaacaccaggaaattcatctcacaaggaggtcttggcctaagcacattgtcaccaggttatccaaagttaagacaaaggaaagaatcttaagagctgtgagacagaagctccaggtaacctatacagaaaaacctatcagattaagagcagatttctcagcagaaaccctacaatgcggaagggattggagctctatcttcagcctccccaaagaaaacaattatcgaccaaaaattttgtatccagaaaaactaagcatcatgtatcaaggaaagacagtctttttcagccaaacgaatcctgaaagagtttgccattaccaagccaccactacaagaactgctaaaaggagcttgaaatcctggaacaaacctgaaaacaccaaaaaacagaaactctttaaagcataaatcacacaggacctgtaaaacaaaaatacgttaaaaagcaaaaacaaaagaaccaaagtacacaggcaacaaagagcacaatgaatgtgatggtgctgtcatttcaatattaacattgaatgtaactggcctaaatgcttcacttaaaagatacagaactgccgaatggataagaactcaccaaccatctgctgccttcaggagactcacttaacacataaggactcacataaaataaaagtaaagatgcggaaaaaggcatgtcatgcaaatgggcaccaaaagaaagcaagcaggggtagctatgcttatatcagacaaactttaaagcaacagcagataaaagagacaaagcaggacattatataatggtaaagcaacttgtccaacaggaaaatatcacaatcctaaatatatgtgcacctaacactggaactctcaaatttataaaacaattactaatagacctaagaaatgacataggcagcaacacaataatagtgggagtcttgaatattccaatgacagtactggacaggtcatcaacagaaagtctacaaagaagcaatggatgtaaactatacctgggaacaaatgggattagcagatgatatatacagaacatttcatccaacaaccacagaagacactttcgattcagcagcacacagaactttctccaagacagaccataagatagaccataaaatgagccttgataaatttaaggaaactgaaattatatcaagcactctctcagatcacagtggaacaaaactggaaatcaacacaaaaaggagcctttgaaaccatgcaaatgcattataatttaaaaacgtgctcctgaatgagcattgccacaaaaacaaaatcaagatggaaattaaaaaattcattgaactgaacaacaataatgacacaatatatcaaaacaccaagcagacctaatagacatctacagaactctccaccccaaatcaacagaatatacattcttttcagcaccacaccacaactattccaaaattgaccacatacttggaagtaaagcactcctcagcaaatgtaaaagaacagaaattataaaaactgtctctcagaccacagtgcaatcaaactagaactcaggattaagaaactcactcaaaatggctcaactacatggaaactgaacaacatgctcctgaatgactactgggtacataacaaaatgaaggcagaaataaagatgttcttggaaaccagtgagaacaaagacacaacataccagaatctctgggacacattcaaagcagtgtgtagagggaaatttgtagcactaaaagcccacaaagaaagcaggaaagatccaaaattgacaccctaacatcacaattaaaagaagtagaaaagtaagagcaaacacattcaaaagctagcagaaggcaagaaataactaaaatcagagcagatctgaaggaaatagagacacaaaaaacccttcaaaaaattaatgaatccaggagctggttttttgaaaacatcaacaaaattgatagactgctagcaagaccaataaagaagaaaagagagaagaagcaaatagatgcaataaaaaatgagaaaggggacatcaccaccaatcccacagaaatacaaactaccatcagagaataccaaaacacctctatgaaaataaactacaaaatctagaaggaatggataaattcctcgacacatacatcatcccaagactaaaccaggaagaagttgaatctctgaatagaccaataacaggatctgaaattgtggcaataatcaatagcttaccaaccaaaaaaagtcaaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagtccaatatctttgattaacattgatgcaaaaatcctcaataaaatactggcaaaccaaatccagcagcacatcaaaaaatttatccaccatgatctagtgggcttcatccctggggtgcaaggctgggtcaacatatgcaaatcagtaaatgtaatccagcgtacaaacagaaccaaagacaaaaaccacatgattatctcaatatgcggaaaaggcctttgacaaaattcaacaacccttcatgctaaacactctcaataaattaggtactgatgggacatatctcaaaataataagagccatatatgacagacccacagccaatatcatactgaatgggcaaaaactggaagcattcccttggaaaactggcacaagacaggcatgccttctctcaccactcctattcaacatagtgttggaagttctggccaggacaatcagacaggagaaggaaataaagtgtattcaactaggaaaagaggaagtcaaattgtccctgtttgcagatgacatggttgtatatatagaaaactccattgtctcagcccaaaatctctttaaactgatgagcaacttcagcaaagtctcaggatacaaaatcaatgaacaaaaatcacaagcattcttatacaccaataacagacaaacagagagccaaatcatgagtgaattcccattcacaattgcttcaaagagaagaaaatacctaggaatccaacttacaagggatgtgaaggacctcttcaaggagaactacaaaccactgctcaatgaaataaaagaggatacaaacaaatggaagaaaattccatgctcatgggtaggaagaatcaatatcatgaaaatggccatactgcccaagataattgatagattcaatgccatccctatcaagctaagaatgactttctcacagaattggaaaaaaattactttaaagttcatgtggaaccaaaaaagagcctgcatttccaagtcaatcctaagccaaaagaacaaaggccggaggcatcatgctacctgacttcaaactatactacaagtctacagtaaccaaaagagcatggtactggtaccaaaacagagatatagatcaatggaacagaacagagccctcagaaatattgccgcatatctacaaccatctgatctttgacaaacctgatgaaaacaagcaatagggaaaggagtccctatttaataaatggctctgggaaaactggctagccatatggagaaagctgaaactggatcccttccttacaccttacacaaaaattaactcaagatggattaaagacttaaatgttagtcctaaaaccatcaaaaccctagaagaaaacctaggcattaccattcaggacataggcatgggcaatgacttcatgtctaaaacaccaaaagcaatggcaacaaaagccaaaattgacaaatgggatctaattaaactaaagagcttctgcacagcaaaagaaactaccctcagagtgaacaggcaacctacaaagtgggagaacatttttgcaacctactcatctgacaaagggctagtatccagaatctacaatgatctcaaacaaatttagaagaaaaatcaaacaaccccatcaaaaagtgggcgaaggatatgaacagccacttctcaaaagaagacatttaagcagccaaaagacacatgaaaaaatgctcatcatcactggccatcagagaaatgcaaatgaaaaccacaatgagataccgtatcacaccagttagaatggcgatcattaaaaagtcagaaaacaacaggtgctggagaggatgtggagcaataggaacacttttacactgttggtgggactgtaatctagttcaaccattggggaagtcagtgtggcagttcctcagggatctagaactagaaataccatttgactccgccatctcattactgcgtatatacccaaaggattataaatcatgctgctatgaagatacatgcacacgtatgtttattgtggtactattcacaatagctaagacttggaaccaacccaaatgtccaacagtgatagactggattaagaaaaggtggcagatatacacaatggaatactatgcagccataaaaagggatgagttcatgtcctttgtagggacatggatgaaattggaaaccatcattctcagcaaactatcgcaaggagaaaaaaccaaacattgcatgttctcactcataggtgagaactgaacaatgagaacacatggacacaggaaggggagcatcacacaccggggactgttgtggggtggggggaggggggagggatagcattaggagatatacctaatgctaaatgacgagttaatgggtgcagcacaccaacatggcgcatgtatacctatgtaacaaacctgcacattgtgcacatgtaccctaaaacttaaaagtataataataataaaattttaaaaaaagaaaaaagaaaactaaagaatgtacagaatcttaataatttctatactgaatacttattgaaatcaaaatatttaagatatattgggttaaataaaatatactactaaaattaaaaaaaagaaagaaaaagaaaacagcccaaacttgctggttccaaaaataaaactggtttccctttccagtctctccaaagatctaaagactctcaatgttaataatgtcacctagcttctaatattaaagacaatgccacatgctttaagtgtcagaaataaaagtcatatcaaagttgtcaatggaaggtcctttgagaagacttcagaaagattttaaagtgtgtttcataaatcctaccaatgaaacaaaaataattctaagactcctatggtaattatcccactgcacacacacggactctcagctccaacccaagaagagtcagttgcaaagatatttgtgagtgtggctcttgtatagtgttttaaatgacaatttaaaaaacacagaaatattacaatgttttttaggaaattgcattgaaggaagcaccttagcattttcttgtaaacagtagtgtctatttttggttatttactcctctcttcctccattgtatgctgagaatgagaaagaaaaaccctgtctctagtccatagacctgaaaatagagaaccagaataaaagagctgtgcattggaaattgtaccccaagagctttgtcaacactcactctggatatagaatttgacatcctggatgtcaaattgagctcatgatgggacaagatgttaactgacctgggaactcctgaatcccgctttcccaatctaggatccctgaattgccattacaggtctaacaaactcgctggaaaggctttacctgcattaccctgtacctacatgaaaatgtaccctcttattctatctagagttaatatttacaccagaggtttcctatagcatttttcatctctcagtttctcaatgtgtatattaatggattcaacatgggtgtgataactgtataaaacacagtaatgaatttattaataggaaagtttgaaacaggtctaacatacaggaaaatacagggaacaaaaaacaggacaaccacggtaatgtgggagctgcaggtagacagggctttatgcctcccttcctgactataagttttaagggagattaggatgaccccacaggagattagtagaaggatgaacaagaccatacagattcctccaccattggcaacaacagtgaggcctataaagtaggtgtcagtgtgtgccagttccaataatgggtacatgtcacagaaaaagtggtcaatgatattgggaccacagaaaaggagactgtacgcaactaaaatttgaaacacagaatgcacaaaacccgcagtgacagccaccaccaacagaaggatgcaaacctgtcaattcatgatggtgaaatagtgcagtggcttacagatggctacatagcgattataggccatcaccaacagaatgaaggcctcagcaccaccaactaagtggtctataaaagggctgacccatgcaagctcggaaggaaatagtctttttatcatggagatagcttacaatcaatttgggaggaatggtggtggaatacacaacatctataaatgacaagcagacaatgaagaagtacactggggagcctaaggtgggggtggcaataatagtcaccacaatgggcaggttccccaccatagtcataatgtatgtgagtaaatgtacgacaaataatgcattttacacatcaggatcctgagtaaggcctaggaggacaaatgctgtaacatcgctactcagtctcattttctattctctgaggcttgtatcagagtaaagagctcaggagaacaggacctgtaacaaaatactgaacaggaatatgaacacatccacgatgtcacagagcacttcttcatcattgtatcttcaatagtgatttacacacatgataaacattttgtaagtctctattgagttcctcatctcctcaaagattttcgtttcagcctacagttaacagcttctgcctctaagttttagtgaatattctgtacagaagaagagttaaatgcccaacagccattcatatatttcataactccttatctaaaacatatttcttggcacagaagtcagctatgatgaataggcaacagattattggtctcaagaatgttactttctcatggtggtaatagattctaaataaataaattcgtgtatattcagtgctttgagtttgtagttcttgtagtatctttatgatctgtgtagcatcaaaagtaatatcttctgaaatatctcactcagtactgtggcattccacagtcacacattcagtccttcatgcctcgaaagatgttcagtctttatgaacacctcattaaatgtcaagagactggacattaacctgaataaatagcaaaatattatttatcacattattccctgtagcaattacttggtctgaccctctgttgccttataaggagctgcacatctctgcatcttattcttgcctattccacaattttttaatcatatttacatacagtatcctgattttcaccaacaaattttgaactcaagaaaactaactgatggctatcaccaactgccacattagctgtgagttttttttctgatttcttggggtgaactagatagtgagagaggagaaaataaacaccgtacaaaaaggtacagaacagaggacactgttttatttttaacactatttagataccaagagtattcaaaaatagaaccttagtgtccagattccaaaaaaagcatactgaaagagaaagtccacgttcactgtaagatgacatcaatttgagtcattttctgaatgaatttacatgtctgtctcagtttgctcactggaaaacaatgtgattgaattagatgaactgagaatcgtttccagtcaaccacctacaaaactattagtgcacccctcccttattatattctgctgactctttcatttttcatatatttataattaaatagcaatttccaagctcataactgttacatgaataacggtagtcagtggtagatgtttcatgattagagtgagtaaattatgactacaagtttcccactcaatatgtgcctatttaagattcaagaaatccttggaaacaaagtgtagcatgtggcgaataatggggacaaaggagccacactgcctcagctacaagcccagtttcaccacttactatatgattttgggccacttactaaactgctctttgcctcattttcatttgaaacatctagagttcttttattacaacaaagtaaagtttcctagaacactggctggcacctggtaaaggcccagtaaaagacagctaatacttgtgttcctgaatgcttcactgtgaacactggatcaaaacaaatcatgctgctataaagacacatgcacatctatgtttattgtggcactattcacaatagcaaagacttggaaccaacccaaatgtccaacaatgatagactggattaaaaaaaaatgtggcacatatacaccatggaatactatgcagccataaaaaatgatgagttcatgtcttttgtagggacatggatgaaactggaaaccatcattctcagcaaactatcgcaaggacaaaaaaccaaacactgcatgttctcactcataggtgggaattgaacaatgagaacacatggacacaggaaggggaacatcacacactggggcctgttgtggggtgggggaggggggaaggatagcattaggagatatacctaatgttaaatggcaagttaatgggtgcagcacaccaacatggcacatgtatacatatgtaacaaacctgcacgttgtgcacatgtaccctaaaacttaaagtataattaaaaaaaaaacaaatcatctgcatctttgtcaatttgaaaatatttataggcatagtccagaggaaaaaataatagaagacacatataattcaggaaaagcttttggggacacaatataattttatgtcttaggtattatccatttaattatgtatgagtagtgattttatctgtgatggaaagtatcttgacaatatcaggcagaattatagtagaaaatttggacccatcatcagacagagagctaaatggttaaaaaaatgaaagaaaaagtgatcaaatcggaaaacagagtaattacaataaataacttaatgtccatgggtaataagaagataaaaattaatgtgataactgagtctagtgttcttctaaaaatcttcagagagtgaggaaatactggaagcacaacccgctgtggtccctgaggagactcaagaggcttcttggggtagccaaacaaacacagagcaaatcctaataaacaccaaaaagaaaagaaaagaaaactcagaagaaaaacaaaacacattgatttatcaaagtctctccatctgatggttaaagacaaacttaaattatagagaacaatgggacaagttgagataaaaacccagactttgtgattattcactgctgaggaaaactgcagaattactaaacctcgaatgtagacaggatgattccatttacataaatctggcagtggaagaggacgtgtgcagagagagtctgagctgtctctagaagccagctgtgatgcactttccacatgtctcattcatgttaccacttccagctgacaaagcgttctggcactgttgaagctatagacttatagagatgcacatgctgaagaacacaagagaataatgtagcctatagcgaattctggtttttttttttacatcttgcttgctgcaaagtttagtgtgttttccccctttcaccatcaaaactacattcaacaggaaaattctatttgggaatttaaatgtttacttgtaaaactagggtataaaattatcctttatagtttaaatagttaaaaacataatactttaaaagctgaaacatagcattactaggctttcaatgtaaactgctaagttaacaattttctagaaaaaatgatctaatataatttcctgagttcatgccattttcaaaagataaaattctgtaataacacaaaaacatctataatattatgtttcacagtcacagttttataaatctatttaaatgacagctgactaggtaccttcctgaccataggtatccattagtatgtttgctgaaataatttttagattcataagtaaaatcctgtattatgcttccagaacataacagacatttgttcatttacacttcaacaaacttgacatgatccagaattttaaattctctaatcaaatatatctgaaagtaattgtacacatttattaatatatcatataaaatataatatcacaaacactaagattacacatctattgattcatttattattaggtgtaatatggaacatgtttttcttcttatttgacaaatggaaacatacaaataggctgtatattaaaatcaaatatacattgtatacattgataaatttccatgtgtgctagcttaatttttccaattagaatttatcaaataaaaccattggtttttaagatattagctacatttcaacatatcacaggaatttttaatgaattatctcttgtcaatggtttcaaatactcacatcttggtccagaaaagcaatgcttctttcactgaggattgccatagatacctcatgcctctatgtgtcctcatgaaacacaggaatatacgtggctgatccatggatatagaactagttcctagtggctacagtttccacagttccatgcaggcttctcattatcttagtctttagagaagtatagcactatccaaagcagatgaccaaactataataatgctttaagataacgacaatatttactgtgaaaggtaattgaatattctcacgtgctggaaaatgccttcgaagaaaaacaaagagactgtctctgcttgactatgtaaaagtggaactaattagtggaaattaacctggacaacacccttttatatgacacaagtagcaacacttatatttgttacttgaatattttctcaattatagtgaagcaaccacaggtactttactgtcattgaggatttataacattcatgtgcccagctattaagctttgtacgtaacaaggacaatgctgagatttaacttcatggagaatccagtgacagagcttcccacaggcagaagccaaactcttcagtctttcagtcattcaactagcatatccctaagaccacttctttcctaagtaaaagcatgtctctatatctccccaatctcatcccaggaaattgagaactttcactcatttttacaagcaatggtagacattgcaagaaaatattacacctagaggactagataccaactgaagacatactctaccttgggcagaaatttaacttttttgatatctcctgggctgctctatcagaaaaataattcttccatttatgtctgtagacacagtctataacctttacatcaacaatattttagaaagagagagtaacgtcactatagattagttagaatatttggaacaacttcaaatgaaataaactctctgtatacttttttcttacaaaattcctagaggaaaaagatttggttcttgctaaggaaaagtagctaaatgacaagtaatgtgaaatgcctgcaatatgaaaagaataattttaaagtgaattgaataataagttatgagatgcatgttatgaaatatttaggtaaggcaagtaatatttcagccagaattaaaggagaaccagccccaggttctctttgctaaaaatgctcccggtgaggagggccttacccttcctgttagaaagtctgtgcccaagaagccccgaggctcagaggcagagagcctaagaacggaagttgacattctgattcatggaaaaataggtaatcatagtgctgcagttttagttagagtacaggcttttgaggcttttgatcaagacctgtatctaagtcagatataaccataatgatcagtagtccattgatatggtttggctgtgtccccacccaaatctcaacttgaactgtatcttcctcatttttctcttgccactgccatgtaagaagtgccttgcacctcccaccatgactctgaggcctttcaagccctgtggaagtgtaagtctaattaaacctctatttcttcccagtcttgggcatgtcattatcagcagtgtgaaaacggactaatacatccattaactcaatattttaattatattctaatatcaatccaataactgtttctacaataaagaaatttttatttccaacaaggaagcagtatttaagggcttccactgttatttccatgacttggcttaccattggatctattgaacaccttcatctcatcatatgttgagctaaatgtttgatctttgtgtcataagagtcttaaagagtcccataaatacctatctgagatagttaaggtctttatcacataacaggctacactaaaagttagtcattttcaacttagctagtaaatggtttaaacacatcaccccaaatgtaatatgtattactgctaaaattcaaagagcatgtctatacgtgctgtgctgtcttactggtaagtgttaaaacatgcacgaaaatatttttattctgcagaactatcagatatgatcaacgatactgtggtctaaattatgattccaagatgaagaactaatataaaaatatgacctatatcccaataccagagtggaagaggatgcttcctcagccaagctttcatatgagatggtagccccaaccatcaccttgattacagttttgtgagagaccttgaaggatgggaacctaagccatccttagtttcctgacctacagaaattgagaatgagtacatattgtttgaatcactaaattttgaaataatttcctttgtataaataaataactcataaatatatctagagtatgcttcaaatattgggaagcatgccaataaatatttagtgaacctatgaatcaaagaaaaaagtataatgtaaataagcaaatatttagaactcagcaataacaaaaaacaccaaaatgtttgaggtgtgatcaaaacagtacttaaagtaacatgtatagctataaaagcttacatttaaaataaatatttacaagcaggcatctgagccttcaccttaagaagctagaacaagaacagtaaataaaagccaaggtaagtaaatgaaaggacataaatataagatcaaaaacaataaaatggaaaacataaaatagagaaaatgaaaatagccacaagttggtaatgaaattgataaattgccagcaagagttatcaaaggaaagacaaattcaaattaccaatatcagaaatcataaaacaaataatcaacccatagatcttttagacttaaaaggttagaaaaggattgttctgaaatacattatttcaattagtttgacggcttagatgaattaggtaaaatgtagggaaagaacaaccttctaaacatgacacaaaaagaaactgaaacatcccatctctttccaagtaatgagctatccttacttgcagataacatgatagtgttagagaaaaccctaaagaataactttgtaggaataagaagtaaatttacaagtttataggactaaaatgtcaaataaaaaatgcaatttcctttacatacatactagcaacaatgacaaatggattttttaattaaaagtctgtgatgaaatctgaaaacataaatacttatgaatagataaggaagatccctacatgaataacaactacaaaactcttcaaaaataaatattttaaatacctaacagatatactgtattcaggaattagaaaacccaatgttgctcagatgttgttagttcaagatgatttatggatctaacttaaaatgaataaaactacaatatgctctttttgagatgtggacaattttcctgcatgctgatctgcaaggtgactttgaaacttccgcatcaaaggttatcttctatttctgtaaaacctcaaatctgggtggtcatgtgatcactatgacaaatagaatatgatgcaagtgacattgtttcagctccggacacagcccttagctggccggacccatttactttctaccactgggatctctgagcacgatgtaaaaagccagactatcctctggagtgatcttgtgttccttcatctaaagggataggaagaggacccaatgcatctcttaaggtcatcccttccaatatgctttaaatgtgcattaagttatcctgcgtttacataaaattcagttatcagctgaataagacagcgacttcagtccttgccacacaaaacagaagaaacacccagccaacaactgcctgaattcctgactcacaaaattttgagataaaataaaatgaaggttgtttgaaatcacaaaaactgtggagccctgcaccatacatgaagacaggacgagaataaaaagtgacaccttaaagtgtggtgtttccataacaacaatctaaagtgtttggaactggctgtagtatataaaaccaagggcctccatgatattgtaagtaaaggctgaaaatagacataactgtttagtaattctgttacctgtagtaaggtagaaaataaaaaatgtacttaaatgaataggtggatacgactaaaatttccaaacagaatattgaaagttacagctgtttattatagcattgtatgttataataagtcagatttttaaaataatactacttaaaagattaactgttacattttcagacagaatttacaagaaacataaaagagtcagaacttgtgggtgtcaaagatgaaaatggtttccctttccagtctctgcaaagagctaagtactctaaaagtaagagtggtcatcaaattaaaagtcattctgaacttgtgggtgtaaagacactatgaataaacttcagaaaaatttaatggtgggtcacgtaactatcttaaactagacaaatttaattccaaggttcttaagagtattatctgactgcacagagagtttcagctcaagtctgagaaggggcagtttcaaagatatttgtgaatatggtgcttgcctattccacaaagtctttaaataaattacacagaaggaagcaccatagccttcccttttgaacaggagcatctattttaattacctattcctccttttctccactctgtgctgggaatacaggagaaatgtcctgtctcaatagatgtgtaatagagaaaatacataatttaaaatgtacacaataggacctgcacccaagcatccccatccactctcagttctggatatagaggttgagatcttgaacttcaaacagatgccaagataggatgacttcttaattgagcttggagcatctaaatcctgtcttcccactttggtatcccaagagattttctatagcatttctcatctctgaatttctcaacatgtatataaaaggattcaacttgggtgtgataactgaataaaacacagtcaggaatttatcaataggaaagtttgaaacgggtctaacatataagaaaatacagggaacaaaaaacaagataaccatgataaagtgggagctgcagataaacggagctttatgcctcccttccggactataagttttaagggagtttaggatgaccccataggagattagtagaagggtgaagatgaccatacagattgctccaccattgaaaaccacagcgaggcctacgaagtaggtgtcagtgcattccaggtccaataaagggtatatgttacagaaaaagtgataaatgacattggggccacagaaagggagactgtacacaactaaaatttgaaacacagaatgcagaaaacctccagtcacagccaccaccaacagaaggatgcaaacctgtcaattcatgatggtcaaatagcgcagtggcttacaggtggccacgtagcgatcataggccatcaccaccagaaggaagacgtcagtatcaccaaacaagtgctctataaatagctgacccatgcaagctgggaaggaaatagtctttttatcacagagtaagtctacaatcaatacaggagaaatggtggtggaatacacagcatctataaatgacaggcaggcaaggaagaagtacactggggagcccaaaaagggactggcaataatagacaccacaatgagcaggttccccaccatagtcacaatatatatgagtaaaaacatgacaaataatgcattttgcacatcaggatactgagagaagcccaggaggacaaattctgtaatattgttattctgcctcatttacccttctttaaggcttgtatcagagatgagagctcaggagaacaagacctgtaatgaaatagtgaacaggaacatgcttacatccattgtgtcgcagagcaccttttcattgttgtatcctcaatagtgatttacacacaataaacatgcagtaagtctctattgtgtttctcatccaaagagtccatcttcccttgacaattctatttctccacaaagattttcatttctgtgacaggtaaaggcttctacctctaagttttagtgaatattctatacagaagaagtgttaaagtcccaaaagccactcatacattttataacttcttatttaaaatatttttcttggcacagaattcagctatgatgaataggcgacaggttcttggtctcaaatgacttcctctctgctgatggtaacaaattctaaataaataattgacatagatttagtgctttgtgtttgtatgtgtggtatctttataatatgatctgtgcagcaccaagaataacatcttctgaaatatatcactcagtactctggccttgtactattagaccttcattccttcatgcctcaaagtatgttcagtctttattagtctttcattaaatgtcagaagacatgactctgaaatgtataaatagctatattatttatcacattgttccctgtagtgattacttggtctgactccttgtccaacttataaggagctgtgattctctccattttgtccttgcctataccccaattttttcaacacttacatacaatatcttaattttaattaatttgaactcaagtgaactaactcatgactatcaccaactaccaaatatgccatgttttttttttcatgaattcttgagatgagctaggtagtgagagaggagaaaatagacactgtagaaagaggtacagaacagtaggacatggctttattcataacactatttagataccaaaagtactcaaaaatagaatcttagctatcagattccaagaagaagcatactctaagagaaattccaaattccatgtaagaagacatggatttgagtcattttttgaatgcaattacaagtctgtctcaatttactcactggaaaacaatgggattaaatttgagaaattcagaatcctttctaatcaactatctacagaactattagtgcatctctcgtttatggtattctgctgacaattttctttttttataaatatataattaaataaaaattttccaagctcatgactgttacatgaaaaatggtagtctgtgggacaatgggttttattattacagtgagtagtgactataagcttctcactgagtatgcacctatttaagatccaagacatcctcaaagggaaagtgtagcatgttgtgaataatgtggacactggagtcacatttcttcagctacaacctcatgttcaccattttttatgagactttgggccatttactaaagctctctgacccttactttcatcatttgtagaatggggatcccaatagtcattacctcttaattgcttgattttcagcaattttgaacttaagtgaactacctgttgatttataaaagaaagtaaagtgcctagaacactggctggcacctagtaaggactcaataaattatagttattatcagtgttcttgaatgcttcactttgaagatagaacaaatcatgtgaatctttgtcaacttgaaaagatttatagacatagtctaggttaaaaagaataaaacactcataattcaggaaaaccttttggggcacacaataaaattgtatgtcttaggaattacaaatttaattatgtatgagtagtgattttctttgtaatgaaatataccttaatgagaagcaagaagaattctagtaaaaaaaagttgaactgatcatcggcaggagagctaaatggtagaaaatgaaagaaaaaggggtcaaatcagaaaaaaagagaaattatagtaaatacattaatattcacaggaaataagatgattaatttcataattaagtgagacaaattagctgggcatggtggtacacacctgctatcccacctactcaagaggctgaggcatgagaatcacttgaatccaggaggcagaggctgcagtgagccaggatcacactactgtcctccagcttgggtgaccgagtgagactatctcaaaaaaaaaaaaaaaaaaaaaagtgaggctagttttctgctaaaaatcctcttcagaaaaatttattttagtgaggaaatactggaagcacaacctcctgtgggtccctgggtgactcaggaggctttgggaatagccataacaaatagacattgactagatcctagtttaaaaaaaaaaagaaaagaaaagacaattcaaaaagaaaaataaaaacaacattgatctcttagtgtctctagatctgacagttaaggacaaacttaaagaaaaaaaacaatgggacaagtagaaatacaaacccaaactttgtgatattcactgctgaggaaaactacagaattactaaatctcaaatgtagacaagatgattccgttcacatagatctgacagtggaggaggatgtgcgcagagagagtttgagctttcttagaagccatttgtgataaacgttccacatgtctcattcacattaccacttccagctgattctagagttctgtcattgctgaagttatagactaacaaaggcacatctgttgaagaactcaagggtattatataacctatagcccattctctttttttcacatcttacttgctgcaagatttatttccttttcactctttcatcatctatgataaatttcaccaggataaatcttctcttgggcagtttagatgtttacttgtaaaaaccaggatatgtaaactatcctctttagcttaagtcatcaaagatttaatactttaaaaactgaaagacaatattactaggcactcaacataaacaactaagttaacacttttctagacaaaaaaacttaagcttcctaagaacgtgactttttcaaatgataaaatcccatagtaacaaaaataatcccttatagataaaatttataaaacaatacggttttgtaaatctctctaaagaatagtaggctcaatactttcctgaacttgtatatgctgagataatttttagattcacacataaaagaccatatcatgcttccagaacatattaggcattgatttctttacactctaacacacttgatatagtctgcaattttaaattttccaatcaaatatatctaaaaataattctatacctatgttaatgtatcacataataaaatattctacatactagattataaatctattggtttacttattttatgtgtaacatggaacatgtttctcctgttacttggcaaattagaaaataaacacttataaggctgtatatgaaaaccaaatgtacttgtatactctgattaatgtctgtgttttgcttgcttaattttcccaattaagattcctccaatgaaaacatgtgagatttaagactttagctatatttcaaaacattacaggaagtttcagtgagtatcccttgtcaattgcttcaaaaactcacatcttgggtcttgtccttggtccagaaaagcaatgcttctttcactgagggttactgaagatatctcatgcatctatttgtgttcttaaaacatgtgaaaaatgtatggctggtccatggatctagaaatatctcctagtgggacaatttccatatttccacacaggctttctattatctcaatctttcagaaaagtataaaggtatccagagcagatgtccaaaatatagacacttaaacataatgctagaactactgtacaaaggtagttaaaattttacatcccctggaaaatttcttcatagaaaaacagagataatttctttgcatgactatataaatattgacctaattagtggaaattaacctggacactcccattatctggtgacccaactaagcaaaccaaaaatttgtcaacaccaaaatttgtttcttgaatttgtaacttctctgtcaataatggtgaagcaaccatgaatattttactgtgattaaggatttataacatttatgtgcccagctatttaactctatagctaagaaggaaatgctgggatttaactgtgaaaaagccaacgacaaagctttcttatgggcagaagcagaactcttgtctttcagtcattcaagtagtatattcctaagaccacttcttttctgattaaaggcatgtctctatatctcccaaatctcattccaggaaattgagagcttctacaaatttttacaaacaaaggtggatgaaataaaacaacccatctagaggactagataccagttgaagacatactgtagcttgggcagaaattttaatgtttaacctatctatctcataggttattctatcaggaaaagaaatcttccatttatatgtgtacacatagtctatgacttttacatcatcaatatttgtaattaaaaagaccataaggcatttatagattaattagaatatttggaacaaattcaaatgaacacttttcttctagagaacaatccctaggggaaaaatacttggttcttgccaaggaaaaagacttggcttttgtcaagaaagagtaactgaatgccaagtaatgtgaaaatcttgtaatgtgaaaaaagaaatgctaaagtaaattgaacaataaattatgttttacattatgaaatactgaggtaaagcaagtaatatttaagccagaatgacgaggaaaccaggcccagattctcttacctaatcacatcctcagcaaggaggacctaaccttgttgatagaaagtctgtgcctaagaagcctgagacttacaggcagagagcctcagaactgaagttgagattctaacacttagaaaaagaggtaatcatagttgtacagttttaggttggagtagaggtttttaatcaaaacctgaatctgtgtcatatgcaaccataatgataattagtccattaattcaatcctctaatgtatcagtccatttttatactactataaagaactgcctgagactgggtaatttataaaggaaagaggtttaattgactcacaattcagcatgtcttcggaggcctcaggaaacttacaattatagccgaaggcaaagggaaagcaaggcaccatcctcacagggcggcaggaaggataagtgctgaacaaagggaaaagagcccctttataaaaccatcagatctcatgaaaactcactatcacgagaacagcatgggggaaactacccccatgattcaattacctccacattttctctccctagacatgtggggattatggggattacaattcaagatgagatttgggtggggacacaaagtctaatcatatcattctaccctgggcccctcccaaatctcatgtccctttcgtcttttaaagagacagttatgccttcctaacagtccctcgaagtcttaattcattccagcattagcccaaactccaagtccaaagtctcatctgaaacaaggcaaaaaatgtacttcaaagcatttaaaaaactaacaaggaacaaagaaggatatggtggcatgtttctctgtcctagctacttggaaggctgaggtcggagtatcacttcagcctaagagtttgagtttagcatgggcaatatagcaagagagaagagaagggaaggtaaaggagaagggaagggagaagggaagggggaatttaagtctttaatccattttaattagatttttgtatttggagaaaaatagagatctggtttcattctcctacatatggacatccagtttccccagcattatttgttgaagaaacttttccccagcatatgtcttttccctagcatatgttcttggcacttttgttgaaaatgagttcactgtaggtgtgtggaagggaagggggaagggggagagggaagggggaaggaagggggaagtggaagagggaagggtgggggaagggaggggaaagggagggggaagggatggggaagagagtggggaggggagggcaggggaggtttaatcaacaccattaacaaatttgaccaatttacataagagaacaatgtgcccaaaagctgcagaatatacattcttttttaaaattttaatttttaatttttgtgggtgcatagtacttctgtatatttatgtggtacattacatgtttggatacaggcatgcaatgcataataatcatatcatgaaaaatggggtatccatcccctgaagcatttaccctttgcattacaaacaatccacttatactcttttagttatttttaaatgtacaattaacatattatcgaccatagtcacccttttgtgctatcaagtagtaagtcttatatactctttctgattatttttctacccattaactatccttatctcccaccctctcacctccccgctacccttcctagcttctagtaaccatccttctattccccacttccctaagttcaattgttttgaattttagatcccacaaataagttagatatcatgatgtttgtctttctttgactggattacttcacataatataatgacctcgggtcttatccatgttgttgcaaatgagtgaatctcattctttttaatggctgaatagtactccattatatataggtaccacattttctttatccatttatctgtcaatggacacataggttgcttccaaattttggctattgtgaatagtgctgaaacaaacatgggaaggccaatatctctttgatatactaacttcctttcttttaggtatacattgagcaaaaggattactggatcatatagttgctcaatttttagttttctgaaaaaccttcaaactgttttctatagtagttgtactaatgtacattcccatgaacagtgtattaggattccctaatattttgctcactttttcattggcttattagattttttttttttagatggagtttcactcttcttgcctaggctggagtgcaatggcacgatctcagcccaccacaacctctgcctcctgggttcaagtgattctcctgtatcagcctcctgtgtagcagggattacagacatgctccaccacacctggataatttttatatttttagtagagatgggttttcaccatgttaaccaagctggtcttgaactcctggcctcaggtgatcctcccacctcggcctcccaaagtgccaggattacaggtgtgagccaccatgcccagccagatgttttcctatagaattgtttgagctccttctacattgtcattattaattctttgtcagatgggcagtttgcaaatatcttcacccattctatgagttgtctcttcactttgttggttgtatcctttgctgtgtggaagctttttaacttgacgtgatcccatttgtccatttttacttgtgcctttctgtgctagggaaatattgctcaagaaatctttgcacagaccaatgtccaagagagtttccccaaccccaatgttatcttgtagtcgtttcatattttgaggtcttacatttaagtatttaatccattttaattagatttttttgtatttagagaaaaatagagatctagtttcattctcctgcatacggacatccagttttcccaacattatttgttgaagaaactgtcttttccccagcatatgttcttggcacctttgttgaaaatgagttcactgtgggtgtgtggatttgtttctgggttctccattctgttccattggtctatgtgtctgtttttaggccagtactgtcccattttgcttactatatctctgtagcataatatgaagtcaggtgacatgattcctccaatttggttctgttgctcaggatagctttggctagtctgcatctttagtgattccatgtaaattttaggttagatttttttctatttttgtgaagaacgtcattggcattttgatagggattgtattcaatctgtaggttgctttgggtagtatggacattttaacaaaattgtttcttccaatccatgaacatcaaatattttcccttttttgtgtgtgtcctcttcagtttccttaatcagtgtttacggttttcattatagagatcttccactttttggattaattaattcctaggtatttaatttaatgtgttgcttttttaaatgggattatttgttctttttcacattgctcactgttggaatatagacattctactgacttttatatgttgatttggtgtcctgaaactatggaatttattatttctaacagtttcgttgtggttattccaaatataagatcatatcatcagcaaacgaagataatttgacttcttcctttccaatttgtattccctttatatctttcttttgtctaattgccctagctaggacttccagtactatgctgaataacagtggggacagtgggcatcttcgtgttccagatctgagaagaaaggttttccatgtttcaccattcactatgagactaactgtggatctcccatatatagcttttattatgttgaggtatgttccttttacccccagctttttcagggcttaatcatgaagggatgttgaattttatcaaatactttttcagcatcagttgaaatgatcatatggtttttacccttcattctgttgatatgatgtatcacactgattgatttacgtatgctgaaatcccagggataaatcccacttggtcatgatgaatgatgtattgctgaattcagtttgctagtattttgttgagggtttttgcttcaatattcatcagagatattggcctgtagttttgtttgttgttgttgttgttgatatatccttgtctgctttcagtatcagggtaatagtggcctcagaataagtttgaaaatattccttactgctctattcttcagaatagtttgagttggattggtattaattcttctttaaatgtttagaagaattcagatgtgaagctatcagctcctgggcttttctttacttcgaggctgctcaggttttggatttcttcctcattcaatcttggtaggttatttgcatctaggaatttgtccatttcttatagattttccaatttatcggtatataattgttcatagtagccactaatgatccttcgaatatatgcagtatcaattttaatgtctcctttttcatttctgattttattcatttggatatttttccttagttactctggttaagttctatcaattttgtttaactttaaaaaaaaaccttttgtttcattgatattttgtatttttatttatttatttctgctgtgatccttatcgtttcttttcctctagtttttggctttgtttcctcttgcttttctactcctttaagatgctttgttcgcttgtttatttgaaggggtttttttggtgtaagcacttatagctataaacttccatctgagtaatgctttctctgtatttgatagattttggtatatttgtttccattgtttgtttcaagaaatttatcagttttcttcttttttttaagtcagtataatttatttttataataatctacattcacgagaatgcagtaagattctgcactgatatattgctgctgagaggtaattgatataaatctagaaaaccatttgaaagtaggaactgtctttcaaatgcccctccctttaaaaagacaaaggaaataccataaaattaatttcttcatggaccccactgatcattcaggagcattttgtttaatttccatgtactagtatcgtttacaaaatttctcgttattaatttctagttttatttccttgttgtcagagaagataattgatattatttcaaattttttgaatgtttttggacttgttttgtaacctaacatatggtctatccttgagaatgatttgtgtgctaaggaaaagaaaatgtttcctacagccactggatgaaatgttctgtaaatacttattatatccatttagtctttattgcagattaagtctgaagtttctttgataatattctatccgaaagaccttggatacaaaaaaaattgataaattgaacttcatcaaaataaaaactttggctcataaaaactgttaataatatgaaaaagtgagccatgcattgtgggtatgcttacaatacatatgtctgaataagaacttgtatctagaatgtattaagaagttttacaagtcaagacaagccacatgatttttttaatgttcaacagactagccaagaattatatgctcaatatctttagtcatccaggaaatgcaaattaaaaccaatccaattgttactgatgatgcggaataactggaactctcatatgtcccttgtggaagtatataattttacaactgtgttgaaaagctttttgactgttataaaatttagtctttacccttcctcctaactagcatatatctacaatactacaacccatgtgtcttggataaagacatgttaatggcccaaaataaatccctgtatgggcagatataaacacacgtgtggtccagtgcagctcagtgtatggcaagatatagccccatgtgtagacagacacagaactgggtgatatcatatgcaaaacttatataaatgcaatcataaaagtaatcaaatactgatctttgtgttttcacatacagacctgtgtgttcatatatagactttgtgttcagttagatacagacccaaaagtatcactggatacacacctatatatggtcatacagacatatatgctgctggatacagatacgagtgcacagtcaaatacagactcctatataatgacattcaaacctgtatatagtcagatacaagtctatgtgtgtctgaatacagacctatgcccatggctttaaagactgtgccaggaaatgccaggaaaagatgctgagtcctctcttgtcaggtcattgaaaatattaatcaaatgtaaataagagaattccctttttaaatgaaaaagtcaaaaagcaaggtatacatagactatgaagatgtttacaactttttttaatctttaagttcagtggtacatgtgaaggtttgttatggggatgtcatggaggtgtgtcattttagaagtctgacatagggagtcgttgtatggattatttcctcacctaggtattaagcctagtacccatcagtatttctgtgatcctctcacacctcccaccctccatcgtgtctgttgttcctctctatgtgttcgtgtgttctcatcatttagctcccacttagaagtgagaccatgtggtgtttggttttctgttcctgtgctaatttgctaaggataatggcctctggctccatccatgtttctgcaaaggacatggtcttattcttttttatggctgaatagtattccatgctgtgtatgtaccacattttctttatccaatctaccaatgatgggcctttatgttgattttgtgtctttgcaattaatagtgttgcaatgggcatgtgcatgcatgtgtctttatgttagaatgctttatatttttttgggtatataaccagtaatggggttgctggctcaaatagtagctccatttttaggtctttgaggaatcgccacatggttttccacaacggttgaactaatttacacaccaatcaacactgtgtaagcattcctttttctctgcaacctccccagcacctgtaatttttttactttttaataatagccattctgactggtgtgagatagtatctcactgtggttttgatttgcatttctctaatgatcactaatattgaccttttttcatatgcttgttgacagcatgtatgtcttgttttgaaaagtgtctgtgcatgtcctttgtccactttttgattgagatttattgatcaagacttcacaataagtgtcttattctaggtaggaaaatgagatattataatacaccattttgctcaaaataaacaagtaaggtcatgaaaccctaaatataattttatgaaaagtattcaagctttacaaaacagtcctaaggtttattaggaaaaataaatatttagaaattgcaagaaagctgaaaaagattagtaattaggggagactatctctatttaaatatttaaaatccttgaccactgggatagtgtgttggtgaaaaaaaaaaccaaaaaacaagaaaagaagaaacagaagaagtgtcctgagattgaaccttctagatgtaaagaatttgacatactaaaaggataaattccaaattgctattgaaaataattaatggattagattggcaggttattttacctgtttaggaaaactagacttcaatattttcttatgataaagaaaaataaattttccattggctggaaaacaaatgtttttgtaaagtgatttttttaatggggacgactggaggcaggagagggggagatgggcaagggctcaaaaactacctgctgggtaccatgctcactacctgggcgtgggtgcaatcatacttcaaacctcagcatcatgcaacatacctttgtaacaaacctgcacatgtgcctcctgattctaaaacaaaatctgaaaagaaaaataaataaataaaataaggtgttaaaaagtgtaaagtcactagagggaaatggaatttactgaggtgtgatgtgaccgaaaaaaataagaagtaaaaaagttaaggtaaaacatttctatataaaaacatccataattgtagcatcaataacatagtaaggtaaatatttatagcaaatatcaaagaatggtatgaacatatatgcatctttgatacggaaaaattttatcagaatgtatcagtaaaaattctacctccaatagattaagaactcaaggaaacaagtaattaacaaagtttatggagtgggctctatgtgtcatacattgtgcaaggaacagagagcacaaagagaagtaactttccctgacttcggggaactttcagaccaataaacataaacagacaattaaccaagatttttttatttcatcacttaatagaaccatacaaattagaaaattaattacatgtccaaaaatgcaggacctagttatataaactctgatactaccaaatgctcaatactatttggagaatggtgctatgttttggaagagcttggattatgtaagaaatctccatgtaataataataaggataaaaataataatacaaagtgaactcacatagtgtgatttaccagggaaattgacatgtttttccctagccttagtccctcatgaatccagagtacagaggagaagcaggaacaatgagtttctttgattacatgttttctacctgtagtcaggggcagataaaattttatttcaagcctgattcaaaaggaattttcacacagatttttatgaattaagtgtctttccaacgaaacaatatgttttagtcctttttttacctaataatctgcattctatcaataaagtaagaatggaagcatcatatattgccagcatctttttttctttttctttcttttttttttctcagcgttgctctgtcacccacgttagagtgcagtagcgtgatcatggttcactgcagtcttgacctcctgggctcaaaaaatcgtccaacctcagcctcctgagcagctggaaccactgacatgcaccaccacaactgtctatcttccttgaaaatggtgtattccaaaatatttactatctggctctgcattccatatttgaagttcatagattatggattacgctaattttacatatgaaaagcagagcctggctgttttttagaaggccatgagaagggggtattgaaaatagcagagatattatcagatattctaaacatctgggaagatcaatggatcatttttacataaatatagcaccaaatcaagctgcttcacctgaggacttaatatgatttctcaattggagaaaaaagtaagatttagttatttttctgcatgtctccctttttcattcagattcttttagtatactgtctccttatgtataatactgaaggaagcactattcctcttcaaccttaatatgctagcaatatgaacaaaattatatataaatagtatcttacaaatacaaaataaaatatatacttcaaatattaatgtggtctgtatttgtgtggggaggagtaaatgaaatttttatgtcttatttcttaattcattcttctgaaatctgtaatgagcactattaattccaaaaagggattaactttatttaaaagaaaaacatgagaaaaactttcataaacttaaataaatttatagtattaataacataaatttatcatctcgagagccattctacaaacaaaaagtgaacatatatttttccaataaattattaaaattttctaaatatattttgattattgcaagtattcatgtaataaatgattttcactgcatactagttattaaacctgaggaaaatttcactgccattaaataatcacaaatggctttcctggagggagcaactcttcactgaaaatagatgatacatttgtctgccacctcattttctttttctagtccagagcttcttcatagcatttttcatctctgcatttcttaaagtatagattagagggttcaacataggtgtgataacagtgtaaaacacagtcaaggatttatcaatgggtaaggtcaaaggaggtctcacatacatgaaaatacaagggacaaagaagaggatcaccacagtgatatgggagccacaggtggataaggctttgtgcctcccttcctgactaagattcttcagggagtgcagaatgaccccataggagaagagtaagagcataaagatgaccacacagattgccccatcattggcaaccacagtgaggccagtaacataggtgtcagtgcaggcaagttttaataaagggtacatgtcacagatgaaatggtcaatgacattggggccacagaagggaaggttgtaaacaaaaagaagttgaactacagcatgcaagaaacctccagcccaggccaacagcagcagtagaatgcacacccgttggttcatgatggtcaaataatgcaggggtttgcagatggtcacgtagccatcataggccatgacaacaaggagtaaaatctcagcacccccaaataggtgtcctataaaaatctgggtaatcaagcttggaacgaaatggttttcttctcatagagtaagtctataatcatatttggggtaactgtagtagaatgaacagcatccataaatgataagtagccaaggaagaagtacatggggcatccaaagttgggctgaccaccacagtcacaacaatgaatatgttgcctaccattgtcacaacgtagatgagcaagaacacaagaaataatattttctgtccctgggggctctgagtgagccccacaaggacaaactcagtcacatttttcctttgctccatatgcctttctgtatgtccttattccagttgaacacaggacaaaattacttaaaaatataattgttactagtagcttcattaaattttaggataatttgtttattcattcaacaaataggtgttatgagttattatgttccagaattgcaagacattataaaaatataaggctgattaaagcatggtccccaacctcagcaatcttacaaattaattgagagagaaataagtaatttgggatgtatatgggaaaaggacagtttattaaataaaagagtttgccaaaactagttttacatctggaagatcataaaattatacatatagctaataccataaacaaaaataaatacaaatgaattaaagatttaatataaaactaaagctagattttctttatatttactttccagttaataaaggagatgactttctacattctctggatgggagaatcttaaaaattgaaatccaaaataaacatatttgacaatttcaaaattgtttaagaatttgggaaaataataccatttaaaaatatttataattttgagggcacagagttaatatttaaaatagaaagagtgctctaagcaattaataaataagagacaaaccaatagcaaactgggcaaatgatagaaaccagcaatttaaaaagaaacagtacattaacgtggccaaatataatagtgtgctgaagttcacctataaatagaaaaatacaaaatataaaacaaatatcaccttatattcatgaaactgacaaaaacgttttaaaagtgatagtagctatagctagcaaaaataaaaaagggtattttcttgcactgatagggaaaatatggattttataatatttttggaacaaaagttagcaatctctaatgaaagtaacaatatctttcaacacaactgctcccttcaaaagctaccccatagaaattagagccctagaacataaggacagatgcatggcatgtttttgtgacattatttataatggcactaaacaaacaaaaaatatggaatacagatatttaaaacaattaattgcagccatttcagtataataatatgattcagcaaacaaaataaaaatactatacatgtatccatttataagtgtttgcatatgactatatgagcatgggaaaataacgaaggatatatgttttttgttgtaagcagggtttacatttgcattggtgatgtgggggagaggagagaagttgtgtgtgaaagaataaaactaacgaagaggagaggaaggaaggaaagaaggaaggaagatggaggaagatggaataaaagagggagggaaagaaataggggagaaggaagggagggagggagggaagagagagttagaggaaaagaaggcttcacacacacacacacacacaaaactatatcatacgtagtgacaatattcactagcccagctatctcctaaaataatcctactaatgacaactaatcgctaagtctctgttgacattacttcaatctaacctgataaataatgtcccatctgtttttcaaatacacagattgtctgtgttgctaacaatggccaacctctctagaggttgcactagattccgtgctctttaccactcttaagaacagtgttccttcaattttctccatttcgaatgtcaacaattttcctccctatattgcatccttcttccagcatatttgtatgatctatccccacgtttaaaaatatatttatacccctggacagcatatctctttcaagcaaccaccccatcttgattctctgttattctttctaaataacactttcactttactaaatcaagtggtcaatttcaatactcttcttacttgacctatcattcctatgaattgaagtaacaccttgcttactttagtcttaccttgggttcttgaaagtcactcattccacttctacagatgctatatcatctaatttttggcatattaatcaatgcatagagaacacactgcttgatcctataaagagatttacaaatacctgcccattaaaatatcccccaaatggttacatttgaaattagtttctaagaacactgatgtagagaaagtaaattttttctgttatttaatgttgaaatatccaaaaaagtattacagaattgagtcaattcacataaagtttagcaatcatgaagatccactaatgtggtttattatcagaatcacttagagaactattaaaagacagaattcccacatcatcagtgttactgcataatgtaaagcctagtgcagaatctcacacataaataccttcctgggtatctgcataagaagacagtaattcattccgggttctgatgatggtaccttccctcttgtcctaaaaaaataacagctgtgtacactgacaccatctgtgtgaacacagagagtaaaacaacacatgaatcatcactggaccttgaaatgcttccatgtgatcaacgttttccatgcttgttgaaagtttgatttatatcagtctttcagggggaaaaaaggttaccttttaacttattgagattttcaaaatgaatatcaagaatgttctgtaacctaaagaagcctcaatcttgattgtgaactgagacccaaaatcttcactgttggcaaaatttgtcctaataacaaacacatgttatataaatacttttttattttttattttaatggatacattataattgtatatatttatggggtatacatgatattttgacaaaagcacacaacatgtaatgatcatatctgggtaattgggatatccatcacctcaaacatttatcatttctttatgttgagaaaattctaaactttctcttctagctgttttgaaatacagtcaactataaactatagttgccctatcatgatcatattcttcctacctaactgtatttctgtatatattaatcatcaactcctcttcatctgctctcctcactagccttcccatcctccggtaaccaccattctattcactaccatcatgaggtcaattttttatctcccacatgagtgaacacctgcaatatttgcctttctgtgcctgcctcattttatttaatataatatcctctggttccatccacattgctgcaaatggcagaattttatcctttttattacattatctcaccccagttaaaatggctattataaaaataacagaaaataaatgctgatgaggatgtagagaaaggggaatgatcataatctgttggtaggaatgtaaattaatacagccactatggaaaacagtatggaggttcctcagaaaattaaaaatagaactaccatatatctatcaatcccattggtagttatacatccaaaagaaatgaaatcggtatatcaaagagatagctacattccaataatttgtggagcactattcacaatagccaagatatggaatcaacccaagtgttcatcaaaagatgaataggttaaataagcatttcgaagttaagaaaaaacttgaatctgtgggagagagaattgtgactttttactataaatatttgtatttataccaataaaagtaaaataatgaaatagcctttacaacacattgatcttcaatcagttatatgaacctgtattcatgccacatagttgaaccttgggtaatatgaaggatggagaataattttcatccttattttatcatgtttgagtctgtcattttaattcctaaacaatcagtcatgtgaatactgctataaacaaatactcttcaaaataagggcagaagtctgtggatactttatccacatttgaactgcagcacatattgttgagtcattcaactggtgcatctccaaaggtgattcttctctaattaaattcattgggacctttatcataattctgagggtaggctctgtatctccggagatgccacagggataataactatgtataacaagatttatagaatcatgtcctctagggaaaaaattacaaaaggataccaaagtcaaatcaccaaaaggaaacagtccagtctgaatataaacgaaatatataaaacctagtatttaagtcatgacctgcaaaatagacaaatctgttgagtgtatagtcacagacaagcttcattaaggggtccatgtcacagacaaaacgaccaatgacattggggtcataagatgggagcccatgaataaggccaagttgaattactgtgtgcaaaaatcctccagcccagggcaccaccagcagcacaacacacagccattgcttcatgacaaccaaatactgcaaggactttcagatggccctatagttgtctaggccatcagcaacagaaggaagacctgagatctaccaagaaaaaaaaatgtgctttgaagagctgggtactgggtcatacaacattggaaagagaattgcatgtttgagtacgaagtggttgtgcatagtcttatagtccatgaaaaggccaattagttttagagtaaatttcattaatcagataccttactttataccagtcaatttatctcagcatttctaagtgactgcaagacctttcatgtgggaaaaaaaatggtaaaaattaaaataaaaggagaacatgcagagacaaagtggagatcaatgctgttgaatacatcagaaagttcaccaactgccaggaggcacgcacaaggtgttttgaaaaaagatgatagcttaaatatgtatgtttaattttgtatcatccttattttaattacagctgaattaattatagtaggttaaggttgctaaaatatgtgtgtgtgtttatgtatcatgtttattttatttttaataaaatgtgtagtttttaatcaaggagagatgttattgatactcatccaggtcagataaaattcccctttccacaaacagaaactcctctccagtgagtttacttattcatatcctttcagtttattgtctcttatctctggaagtggttatgtaaacagttaatacgtgctcttgggtctcctttgaacactcgtagccccctacctgttgagtagctctctatcacatcatttgtttcactttttacacatttccactctgttatattttatctttttatgtgcatgcttacttgtttattgtctctctccccctgtaacagaaaatgttccttgggatgggcataacggctcacacccgtaatcccagtccctcctgcaggaacactgaatttcaacaactaattgcacacacacaaaagcgcaagcataacaacagaaaaccgggtgagcaatccaagtacctggttttaacttcacatcattgaatgaaacatacttaagagggtaggaaagacagtctcaaatcaccaataacacccctcctaaattccacagcagtggctgcatggtgcaaagagataatctgtgcacttgaggaaaaaaagagtatagacatggggtttggcattgaactcagtactaccttgtcacagcagagagcaaagccatgctgagctcaactgtcacccacccatggagactgcatttggaccagctctagacagaggggaatcactcatcacagaagtcaaaactagaatttcttggcaagtctcaccactgtgggctaaagtgctctgggctcttaggtaaacttcaaaggcagcctaggacacaaggcctgcaattcctaggcaagtcctagtgctgggttggacttagagccagtgcaataggggagcacatgacctatggagacaccagccagggctgccaaggaagtgcttgtgccacccctcccctgaccccaggcagtgcagcttgcagcaacaaaagtgactccttccttctgcttgaggagaggagagtgaattgtgaagagtaaagagggctttgtcttgcatcctggatgcaactaactgaccacagtaggataggggactgggaagagttatgaagcccacatcctaggccctagctcccttctatgtgaagtagcaagcttctgtacatagataaaatcacacacatatatttacatttgaagattattacctgaaacatcttaagaaacagataatagtgacttcctctgatgaagagaactaggagactgcactcagatatggacaagagatttatttctcattttatattattttgtacagtttccatttttgctatttatgattatccatttggctttcaatttttcttttaaaaggtagaaatattacattaaaaatctgtatacagtacaagttcaattggatgaaaaggactgcattgatataaattataccattaactattttaaatagtataagaagaagaatgaacttaaaggacaagaatctaactaaaaatgaaattaagtctcagaaagaaaggcaaaaacatacaggaataacttgattaaaaatcattgtaactctaaaatttcttaactaattcactacatattattgactccttgttttatgcattacgtctttacagataaaatggaaaacaagacattacagatcttacattctagcagagaggtagactgttactattaacacaatcatattgttcattctttaataataattgtaaatgctttgaagaaagggaatatggcatcagattttaaaaaactcctgggtcccaaggagagggctgtaaagtcaaatggctctcttcctggtgggtaactcacttatgtactacttgatatgaggtctctgctctaaagcttcttcatagcacttgtcatctcagaatttctcagagtgtagattaaggggttcagcattggggttatgactgtataaaacacactcactgatttgtcaatggagaaggtcctagcaggtctagcacacataaaaatacaaggaacaaagaagaagacaaccacagtgatgtgggaactgcaggttgagtgggctttttgcctccctttctgactaagtttctttagagagtgcaggatgacaccataagagatgagtaagagcagaaacgcaatagtgcaagacagtcctccattggccaccactaagaggccaataacatgggtgtcagtgcaggccagtttcaataagggatacatgtcacagaaaaaatgatcaatgacattggggccacagaatgggagcccataaataatgctaagttgaaatactgattgcagaaatcctccaacccaggacactaccagcagcaaaacacacacccattgtctcatgataaccaaataatgcaagggcttacagatggccacatagcggtcataggccatcaccaacaggagaaagacctctgacccaccaaaaaggtgctcgataaagagctgggccatgaaagattggaaggatatggaattattcccaaagaacaagtctgaaatcaatctgggggaaatggatgaagaataaatgatatctataaatgttaagccagcaagaaagaaggacattggtgagcccagggtctcactgacagttacggtcactacaatgagcaggttgcccaccatggtcaaaatgtagaagagcaagaacataacaaaaagtactttctgctcctttggattctgtgtgaagcccaagaggacaaagtcagtcacatttttccttggctccatctattctttacagctgcttacttcagatcatataagcagtttacctataaaacaaggggggaaaactttaaatacattatgattttaatattgtatttactcattcaattaaaaatgtgtatgcagtatctatgtcaaatctgtcatagactttggaattgccaagttgaaaaagacacaattttgtactctcagtgatttggtaaataaaataccaaagggaataaattaaataccaattaaataggtgtcataataaatatattgacattattgtaagggttcacagtgctaaaacactaaatcaaactaggatcaggaaagacttttcagaggaagcaatgtcttagctgagatataaaggaaaggtgataattaactagaagagaggatgggaagggaattccacataaaggtgcatcctgtataaattcacagatgtataatactcgagaaaccacttaaggtaactaacttacattttcaaactgggaagagctaattatgaatggatctttgtatgtgactaccaactgacatgttcaattgatatcaatttttaattttccagattaacccatttcttccttattttcatttcattaaatgttactacctaccacactgtttaaactaaaaattttacaatctatttcacttctctatttctttaatattatttatcaatatatttttctcaaaccctgttaactcttccttcaaaatatcccaattggatccttctcactaccatcttgttaccccctggcctactctaatagccccctgcaaaatctctccactcatcttctggcctctaataatgttctttcatgaagtagcccaaatgatcttttgaaaatcttattaatatcataccactcctctactcaaaaaccccatggtggatttatattctgcactcaatgaaatggaatctttctaccttggcctacaagaccctagatgacctggatccaggctacctccccaaatccatcccttacaattgtccacatttatactgctccagacagtttcgatattcaccaaatatacaatgtgcttttccatatccttaatttaatctattttttgtagacacttatttcagagattagaagccacttacttctaaaataatggtcaatattgtggaaatgtgtattgtaagtgtaatcttttatttattcattcaattgaaaaatgtttatatgacacctacattgtgttatgcctctcaaataaagtagactcccagccatcacagaatgttcacaaactcattcagggttagggtttagaccaaaagtgattatcagaggagaaatattagtgctaaccaaggaatcatcttttcaccattagtcacctacttttccaaacagaattatacctcctgaggtgaaaagatacataataactctattttaatctattaatgataaatagtatataaatactggccaacagctttctaaattttcttctcaatgatactgaactttccctgaggaagtctccattgagctagttgacttatttctaatcaacagccttattttagatgctgtgaaaaccaaaagccttatttactgggcttttacataaaccatatgtttaatatgcatgtagaaaatgcttcatttttctcaaagtgtctataacactctggttttagaaaataatttagatagaaagtgatagatgatgatgaagaagatagataatagatagacaaccattttatgagaaatatctaaaccagtaaataaatttttctaacacttgctgtaagatatcaaatgctaatcagtactctgtgtcatattttgtaaatgaaatcatcatataagtttattgagtttttttgagtacctaatgacttaataaaaaaaatatgggagcatatgtagtaccatgcttgtatcaatacggataaagtatctggaagtctttgctgagaatctttttgtgctgctgagattattccactgatgtggatggtccatggctgttatgtgaccgtctgtactacatgaccatcgtgaatcaatataggtgtagccatctcactggaatggcatgtactgaaagctttatccaggcacagtttagatcctctccccagtctgacttcctttctatgaccccaatgtcatagctcattcatgtgtgacttaaacacttttttgaaactcctctgcatgggtactactaatacaattggtttctttgttgctgccaatggtgggttcaactacctgttaaacatcattttcttgatggtttcttaagtggccatcctatgtactttgaaaactcacagcttggaggaaagatgctaaagttctctacctgcatctctcacaccaccatggtcatcttatctttgagttctgtatatctgtgtatctgtgcccagtgacccttccccaatcaataaagcaatggctgtgtttcataccgtgataaatcctatgttaaaacctttagtctaaccctcagaaatgcagaggtgaaaagtgctttgagaaaggtctgggtcaaaagatgacctgaagagagaaataatctaaacataagatgattttaccctttcaatggtgaagagaaaataatataatatctaagactaagcgccaagtaaatatcatatgtcagagatgattctggcatataagccatttgagctaaagtccatatagaaaactatttatcattacaaaaataccctttagatttatttattgccaattttgttgttaatcttcagtgtactgtcacaattgcacaataaagtggtcagacaaaaaccaatttagcaagtgtgattataaataatttacattgtgctatggcttcacagccttggaacttctaaccccaactgtgctctgggtagatttctcagtggaagtgataccttaatgagtttaaagaagtgagagaaaaggatggaaaagggaattccatgaaaagatgtgccatgtataaactcactgaagtatcacactgaagatgcacttaatagatatatattcatagtgggtagaatgcattttgtgtgcaaggctatagaccaaatttctttgtattatttactagggctgccaccttataccaatgacgcttttcctccactttccaataacatgttcctcatttccatttttgaccttaactacaaggaccttgacattcaaatttctagaaacatttagttcatgatgaaatatgtattctctaagataatagatgttttctcctcagctcccctctttcatttctgagccttcaccagaatcactgttcaatgtccatattcctacccacagtaacttgaaggatatccaagctctttctataatgcaccctcaaactctgcaggtatctacccattacccagttgcaaagccacttccacatttgaggtattcattgcagcagtaccccactcccagaactgaaagctgtattattttgctagaacaggtacaataaagtagcacaaactgagtgccttaaacgacagaaatttattgtctcatagttctagatcttagaaattcaaaattaacttattaacagtgttggttcctatggaagactataagggaaggagatgttccaagcctctgcccttggcttataaatgaccaactataggttcctacagaatactctttgtatacatgtctgtatccaaattttcccatctattaaggacatcagtcatactggattagggtccacctcaatcatcttattttaacttgcatacctctgcaaagactcacctcaaataaggttatattctcaagtactaagagttagggccccaaaatatgaatttgtggggggtacataatgaaacaataattgtcatacaacacaatgtatggtccataactctcacagtaccagatatcttaccgacccactgaaactttcttcttagtgtctttacttgaatattgctcgttttcctaacttgtaaattctgaagcactctaaaattgtatgtctttactccatttctcccctaattttcaaactcatatctgcagctatctaattgatgcctccaaatagacttcaatttacgatttataaaagcaaacttttaatttttcataatatatctattcctacctaggtttttttaatcaaattaataaaatggtactcccttttgtgttattgttcagaccaaattttatcagtgtccttcaccctttattctactcacattgtttatttctatacttaataagtcctgttcactcttcctctataatatattacaaacctgatcattgtcactacaccccattcattcctggtctactacaatagccaggtctacctactttcctttcggcatttgacaatctgtgtttctgaagtagcccaaatgatctttttttgttcttatattattcagatcctattactcctttgatctcaacccctacaagatattcctattatatgcttaataaaatccaatatccctaccttggcctgtatactcaataaagtccaatatccctaccttggcctacaagatcttagatgactgggatctaggaaacctattcagctaatttcctgcaattctctatgtttacctgctcaaggtttttaccactcctcaaatattcaaactggttttgcatctttttagttctatctattcttttgcagatgccaatcttagtaatcataagcagtttacctctaaattaatgctaaatattgtagaaaggtgtattataagttcagtctttcatttattctttcaaccaccaagtgtcgattgaacacatacattgggtcacaccaatcaaataagatagactcccaggcatcaccgagcatctactactcaattcatctcaggatctatacaaggggtcattttatcagagaaccaaagtcttgatgctgtccgagaaatcacgttttcaccatgagtctcctacttccctaggtggaggtataactttttaggatatatcatggttgctgacttaacttttgtattttttaaatatactcatgacaagtatcatataaaacctaaccagcaactttgcaccagcaaaagtttttcaacatttcaattcttacaaaatcaaatgatataatttcctatgtagtaaaaaattcacacatctgcaaagcttggtttcactaccacctgttaaaatcttacctttgggaagcttatttatgatttgaaaaacactttacctcactcacaaagagctggaagtctctcttcaatccaatatgcacacagaagacaaaaagctgtatcattccttgatgatatatttgaaatcatatggccacgtctgtccattgtcttcagagtttctaagtatttcagaaaattatgacttgcactgtagaactattttaaagaaattccatggtgcaaacagaaaaactaaaacttttcatgttaggataatttattaaaaatacaaacaaatcctatgtctacataagaagatagtaactagcctttttgagagggaaatttttctctcataacttattttctagtaatttcaataaagaataactgccattccaacgtttagcccatctcactctcttgtcttcttatggccaagtattcaagcttgaaatttgcagaggaaattcttgtccgttttttatatcatgtggtaagcctaataaaacatcttctgaaataattagcccttaaaaggatagtatcttctacctgacagaggcaaatattattgaaaagtttgtaccttataagcacattaatcatggagtcctggaactggattctgtctaagactgacttttgcttaattaagttcacagagattttccacatatttttccagaacatttgcatgtagagatattgtcagatcaatcacataactagggtcagaaagatgtaacaagggagaaaaaaacaaccattatagtaggattgccaatcaagaataaaatatcagcccagccacttctcgctaagaagatgaatttatcacattttccccactttgcaatagcagcttttttccttttatctaattctccattttttctgcctacaagtgtaggtttggatatgtttttaaaatattttatttagttgttataactatttatctatgtatttattattctaaaaaattgttatgagcatctttttcatgccaagttctatgccataagcttaagatacaatagttaatgaaacagaaaaaaaaaaaacagcataaaagtcctgcctacattaactttatatcttctaagaaagtcaggagaacaatttaataaattacaatctgtgatcagtatttaaaatactgagtattgtgatgaaaaataagagtgagatattactgtaaagaaggtaaccagaggttttttttaaatggtgatacttagccgaggtccgaaggatgaaacattgctccacggaaagtattgttacatgtggaaagctccaatatttaaagagctgagcaagtgcaagtcaacggaacgtcttagtacctgaaaggaaatggaaaagagaaaggacagaacaaactgaggttgaagagatggacagaagccaagcccttcagggcagtatagatcttggtaaggaatttatgtttcatttaaagttctttttaaagaaaagtaaaggggacttctaatctagcatgtaaagagcttagaagtcaccactgtaccctaacaacaagaaaaaagctgaacaaactaaaataccaacaattcatcttaaatccatcaaagaagtgagctcacaacgcaaattgctgccctcaaaattgcagagatagacaggcagatagagagaatcacaccttccctgagcagaaacccacaagcagaaaccccacaggagccagtgccaaggagggtagatgtaggtcggaaaaccctgaacttaattgatgtacttcttaatgtggagaagcctgaaagagacacctgaaagataaaaactctaggggagccagtcaaggtgggacagggcagggggtctctcacacttttgtgagttttaacttcatgatccctacctgacactcacagaagatgttagaaaaagtcctgtctgtacgttaaacaaaatttttaaaaaatatatccaaacccacactaatgggaaaaaaaatcaagtattagataaaaagaaaataattgctgtggcaaagtagggaaataagtgataaattcatcttcctggagatgtggaaaaacatttttaaatatccacagtattctgttcttcttaacaaggcctgccctcagaagaacctattgttaacttgctggaattttattacagcctaacctattttaagtaaatgaaatacccaatcatagccttctctaagggcctcttataatggcactaatcccatttatcagggctctaccctgatggcctagtctcctctcagaggctccacctcctaacaccattacatagggggttagaattttaatacatgaatttcagggtgacacaaacatcaagtccatagcaccttcaaaaacagaaattaccaggtcagacaggttcactggtaaattctaccaactatttaaggattatattataccagttctctaaatttcttttagaaaatagaagaggaaagacttcctaactcattcaatgaagccagccataccctattcccaagaacgaagacattacaacaaaagaatacttcagactgatatctctttttaacatatatgcaaaaatcctcaacaaaatattagcagattaaattcaacaatataaagataattgtacaccaggatcaactgagatttagaccaggtatttttgaatgttgattccaccctgcatacctggactaaatctcagtagatcctggtgtacaatttagtccaggtatgcagggtgagatcaacattcaaaaatcaattaacataatccattgtgtgaaatgttaaagggaaaaaatcaaattaccatattaatagatgcagaaaaagcatttaaaaaaatctaacacctatttatgattctaaaaaaaaatctgtaaagtaagaatctacagcccgcatcacacttaatggtgagaaacttgaagctttcctactaagactaggaaaaaggcaagaatgtctcttctcatcacttcttgtcaacattgtcctggaagtcctagctaatgtaataagacaagaaaaagaataagaagtatactgataggaagaaataaaactgtcaatgtctgtagatgacatgatcatgtttgtagaaatttttttaaaatcaacaaaaaactggaattaataattagagcatagtggcaggatcaaggttaatgtacaaaagtcaatcacttttctatataccatcaatgaacaagtataatctaaaattcaaaacaaaatatcatttactttagcattccaaaaaaatgaaatacttaggtataaatctaacaaaatgtgtacaagtgagaaaaactacaaagctctaattaacaaatcaaggcagggtgcagtggctcaggccgttaatcccagcactttggaaggctgagacaggcagatcacctgaggtcaggagttcgagaccagccttaccaacatgcagaaaccccgtctctactaagaaaaaatacaaaattagccaggcgtggtggcacatgcctgtaatcccagctactcgggaggctgaggcagcagaatcacttcaacctgggaggtgcaggttgtggtgagctgagatcacgccattgcactccagcctggacaacaagagtgaaactccgtctcaaaacaaaaaaaaaaaaaatgaaaaaggagaaacaaataaaaaaactaaataaatgaagaaatatttcatattcatggataggaagactcaatattgtcaagatgtctattcttcccaacttaatctatgcattcattttaatcccagtcaaaattccagcagagtattttgtaaatattgacaaactaattctaaagcttatatggaaaggcaaaagaccaagaatagctaatgtgatactgagggaaagaacaaagttggagaactgatactacccaaattcaagacttgctatagaggtacagcaatcaagacaatgtagcattggtgaagaaatagacagatcatacaacagagaaatgatatcagatactttggaagacagtttggcaatttcttatgaaactaaacatactgttatcatacaatcaagcaaatgggatttttgatatttactcaagatgaaaatttatgctcacacaaaaactcacacacaaatgtttctagcagctttattcataattgccaaaacttagaggccatgaagatgctctttattaggtaagtggataaacaaatgtgtgcatccagactatgaaatattattcagtactaaaaagaaatgaactaccaagccatgaaaacacatgaagaaaacaaaatacatattactgagtgaaaatgcctatttgaaaaggttatatattgtatatttccaactatatggcattctggaaaaggctaaactatggagacagcaaaaatatcagtggacattagggtttatggaagaaggagggataaataagtggagcacagaggctttttatttttagttttactttaagttctgggatacatgtgcagaacatgcaggtttgttacataggtatacacttgctatggtgttttgctgcacccatcaacccatcatctaggttttaagccccatatgcattaggtatttgtcctaatgctctcccttcccttgccacccatggcctgaaaggccccagtgtgtgatgttcccctccttgggttcctgttttctcattgttcaactctctcttatgagtgagaacatgtggtgtttggttttctgttcctgtgttagtttgctcagaatgatggcttccagtttcatccatgtccctgaaaaggacatgaaatcgtgcttttttatggatgcttagtattccatggtgtatatgtgccacattttctttatccagtctatcattgatgggcatttgggttggttccaactcttgagcacagaggatttttatgtcagttactctattctacatgatactgtaacagtagatacatgacattacatatttgtccaagctcatagaacatacaataccaagagcaaatcctagtgtaaactaagaactttgagttagataggtgtatcaatagaggtttattgttgtaaaattgtaccactgtggtgtgtggaatgttgatagtagaggatactatgcatgtgtaggtacagaggttatataggatttctttgtactacctgctcaaattccatgacactaaaaaataaaatatgtgtttaaaacaacaacaacctgacaagcaatcagggaaaggaagctcatacgtgccagaggataagtgattctggagcccacatttggagcaaaggtccagatagagagatgagacaatatgaaatgattttaccattttggacataggtgactatggattttaaacaggaatttaagttggagacagattatcagagttagccttcttacttacaaagttataactttaaaaagttattttgaacatctacaagtctcattgtttccctaaaacaaagagaataacatgtaattcatgacattatgatgacaatatgatataaggcgtgtaaagtgcttattcagtgcctaatacacaatagtgaacaatataatttttgatttatttaaaaaacaatgagagtactaattaggttcaacctagctttccttctgaaatcagagattgggtttcttcaggatggtaggccacagacaaatgaaccacacgttcatggatagagaaaaatcaatattattaaaatgtccataccatccaaagtgatatacaaattcaatgtaacctgtaccattgtaatcatgtaaaaattccagtgacttttttaaagtttagacttttttaataaatacataaaattcaaatggaaccacagaagacttcaagtagacaaagcaatctttaggggaaaaaaagttggaggcatcaaatttcctgattaaaaattatgtgacaaagtggttgggcgtggtagctcacacctataatcccagcactttggaagtctgaggcaggtgcatcacttgagaccaagagtttgagaccagactggctagtatggtaaaacctcttctctactaaaaatacaaaaattagccaggtgtggtggtgcacatctgtaatcctagctacttgggaggctgagacacgagaatctcttgaacctgggaggtgcaggctgcagtcagccatgattacgtcactgcactccagcctaggtgacagagcaagactctgtttcaaagaaaataaaataaaataaattaaaaataaaaattatgtcacaaagctattatcatcaaatcagtatggttataaaaacagtatggacataaaaacagacacatagaccaaaggaacagcatagaaagccaagaaataagcccatgcatatacatttttcttcttttttttttaagacagagtctcgctgtgtcacccaggctggagtgcagtgggcaatctcagctcactgcaacctccacctcccaggttcaagcaattctccagcctcagcctcccgagtagctgggattacagttgcccacgaccatacctagctaatttttgtatttttagtagagacgggggtttcaccatgttggccaggctggtcttgaactcccgacctcaggtgatctacccaccttggcctcccaatgtgctgggattacaggtgtgagccactgcacctggccccaggcatatactattaattaatctttgacaaaagtacaaagaataaaacatagagaaaagttactctcttcaattagtggtgttaagaaaactggatatccacatgcaaaagaataaaattgaacccttatactgtaccataaagaaaaatcaaatcaaaatggattaaagaactaaacacaagactataaactataaaactcctagaagaaaacatcgtggaaaagctgcatgacattggtcttgccaataattttttggacaggacacccaaggcacaaggaataaaagcgaaaactaaacaagtgggagtacatcaaaccaaaaacttcggcatatcaaagaaaacaacaaaagtaaaagacagcctagaaattgggagaaaatatttgtaacccataaatctgttaaggagttaatatccaaaatatataaggaatttacataactcaacagcaaaaaaattaataacccaattaaatattaccaaagaacctgaacggatatttcttcaaacaaaacaaaaacctggccaatagataaaagcaaagatgcccaatattactaatcatcaggtaaatgcaaattaaaattacaatgagacatcacctcacacttcttaggatggctttatcaaaaagataagatcataagtgttggcaaggacgtggagaaaagagaacactggtatactggtggtggaaatgtaaattggaacagccatttggggacagagcataaggctcattgaaaaattaaaaatagaactacaatatgggtcagtaatccctcttctggatatacacccaaaggaaatgaaagtagtacttgtagatatatctgcactcacatgttcattgcagcattattcacaataaccaccatatgaaaacaaaacccgaatgtttctcaacagatgactagattttttaaaaagtataataaaatatgaatgtgattattattaaaatatattattatgaattatattaacatagtatattattactatattgataatgtaatatgtgtattataatatattactttaatataatatataatatatataatttatatatacatgtacatggtgaaactattactacaggtatgcactttaacatatccatcatctcacatggttacctttttgcatatatataatataatatatagtattcatatacatgaatattatttcaattttaaaaacaaggagatcctgccatttgcaataatatgaatgaagctggaagacattatgtttagtgaaataagccagactcagaaagaaaaatattgcacaatttctcctctatgtggaatacaaaaaaataaaaataaatagctgaatatgtagaaacagagaatagaacaacagtggttaccagaggcagagggtggggaaaatgggaagatatgtaggatgaataaatctaaagatctaaataaaatgtagtataaaaactatagttagtaatattgcattgtatcactgcaaattttctaacagggtagactttgggtcctctaaccaaaaacaaaaatatatatataagatgcaaaaagataaccatgtgagatgatggatatgttaaactgtgatatacatgtacatagtttcaccatgtacatgtatatcaaaacattaagttgtataacttaaatgtatacaataaaaaataaatagaaatgtgaaaatgaaagtaaagtaagagaagcattttttcaatcgaaggactcttccattaataagcatctcaaattaagttagaagagctgcttgagatttgctaccaaatcatatgctatacaatgttagtcccagaaggttagtcacatgacttgggagatacgaaccaggagcctccgtgcaagtctttgagttggaaatcagttatctgaggctgggttctgacgatgtcaacaaaggcgaagtggttctgcggtcagagaagcagcagcacctgtggagacgtggcaacataaccatggtgtcagagggacagcggctcctttggagcacctgtcccgacagatgtgcttctaaaagctattcctggccattcaggtcagactctgccattctaacccttccaaaggttctttaaacaacttaattgcatataataaatcccttctacttaaactacctacagacaattctgtgtcatcacctaagaaccatggctgatatactaaactgatctaaaattctctatttcaatttgtcacaaagaatggaaagccatcaattgcagaagcattctggttagcaagggtccctttgaaaactgcatttactcataacagcccattctttgcacagaataggcttgacatggaataaacatatgggcatttcttgtgctgcaaatgccatagtgaacaaaacagccaatacctctactttcacggatttcaattctaactggaaaaaatggacaaaaaaaaaaaaaaaaaacaattacatctgacaatcacgtggtgaaaatgttgacaacaaaatgtagcaaagtaatgtgatagaaaataactcaaagagatggagaatggctttacatggatggctcaagaagacctctaaggaggagaaattgaactgcagactgagtaatgacaaggaccaagccatgtgaagatctaaaagatgatgagcatttggggaataaagaagagctagtacagtggcccaagggcaagaatgaggtcactgcagctggagcacagtgaacaagcgagagagtcgtgctggatgagatcaaacagatacatgtttgagtggggaacaattgtatagactctgacaggaggtgaaaacatcaattacaattggttaaatagttttccttttacaaatcaacctagctcaacttcgctaagtgaattttttacatggggataaaagatagaaattaattttaaaacaatagtcatgcagaggcaaagtgcagatcaatgtcattgactacaccaaaaagtccatcagaaacagaaactaccagaggaacacacaaagacttctggagaaggtggttgcttggatgcatgtgctttattttgcttcatcccgattttagttagagatgaattaattataatatgataaatttagttggtgatattagggtcaaaagggaagagagaaattaaagacaagagttgcatcaggtcagataatatccctcctccacatacataaatttatctctactgttttacttatgactttcagctcattgttcctcaccctggataggttaaacactaaattcgtgcacttaaatctttttaaacacccaatctgaagtaatcccaccctgccttctgagttgctctctatcatgtcacagatttcacctttttaagcccttttcactctgaatttatcctttctttaaaaggtttatttattgcacatttccctgactagaatttttctttattcaaatgtgtgtcatttttctggtgtataccatagtgcctaaaagtgtaagttccaaagaaaaactacatgagctcaaatcctacctcaagtattcgctacctctgtgactaaagtaatttatttaaattttccaggcttcatccaattgtgttagaaatcaagaaaaacagtatctatttcataaggctcttgtgcagattagcaagacaatgactttctagcatgaaccacgttgaagtaaatactaataaactttagtaaaattattattataccataactttcttattagtcataaggattctattaaatttgatgtcttctttagactgattttgattttggagacattcacacttttttttttgcatactttaagttctagggcacatgtgcacaacgtgcaggtttgttacataggtatacatgtgccatattggtttgctgcacccataaatttgtcatttacattaggtatttctcctaatgctatacctccccctgaccccctaccccacgacaggccctggggtgtgatgttccctgtcctgtctccaagtgttctcattgttcaattcccacctatgagtgagaacaggtggtatttagttttctgtccttgtgatagttggctcagaatgatggtttccagctgcatccatgtccttccaaaggacatgaattcatccttttttatggctgcatagtatcccatgatgtatatgtgccacattttcttaatccagtctatcattgatggacgttgactacctagatcttggacttcccagttttagtgctgtgagacataaatttctattttttataaattagtctgtggtattttgttacagcagcatgaataaagtaagacaaagaccaaaataaacagaagcccatctactgttcatagatggaagacttaatataattaaggtgacaataatagtagtcaagaacattcagtggaaaatgaattatttcttcagcaaatgatactgggacaactggatacccaaatacaaaggaataaatttggacccctttctcttgtcatatacaaaaattaaccccaaatggatcaaagatccagtgtaaaatctaaaaccatataactattagaggaaaacagaggggtaaatcttcatgatcttggcattagacaatggttctttaaatacagcaataaacaggcaacaaatgaaaaatagacaaattgaactttatcaaaatttaaaacttttgtgcctcaaaggaaactatctagaaagtcaaagtcggttcataaaatgggagaaaatatttccaaatcatatatttgataaggatcttgtataaaaatatgtaaagaactctttacatctcaaaaataaaaagacaaacaactcaattaaatatgcacaaaggggccaggctcagctgctcatgcctgtaatcccagcacttttggaggccaaggcgggtggatcacaaggtcaggaaatcgagaccatcctggctaacacagtgaaaacccgtctctactaaaaatacagaaaaattagctgggcatggtggcaggtgcctgtagtcccagctactcaggaggctgaggcaggagaatggcatgaacccgggaggcggagcttgcagtgagttgcaattgggccactgcattccagcctgggcaacagagcgagactctgtcttaaaaaaaaatgcacaaagatagtgatgtcaaaagatagaatatgaggttccacatcacattccctcacagaaacaccaatataaatatccatccacacatgaaaataccttcacaagagttctagatcacaggtgagaacttacagcacccaagtagaagacacaatcaagaaaagatgcattgaatgagggaatgaacagctttactttacccaagtcaccccttccccaagcccatgcagcacaaggctaagagagaccctctctgtcccagggctctcttatgtggaaaagaaaagtgaagtgagaattgacttcactgcagacgcctattcaggcctgcaccaacagtctcaagcacaaggctgattcacgtgaacttaagcaccaggctcaccccagagccaggcaagtccccacagacccaggcttttaaaccaccccagcactaggccagctctcttagaccaagtcacaaaaccagccctagtaccaatgaggtcctcactaactcaaagccaggctggcacaagtagttaagtcaccagggctgcaccaccccttcaccactaaagcttcaggccagcacctttgcaaggccagcccatgtaactacaggaaccagacccaccccactgccagactagccccagtttcaggcctattctatggttagactgctatgtggatctaggttctaggcctgcctcagtaccaggccagtctccatgaaaacaggctatcagcccacctcagcaccaggcaggaatgcaaaccaggcaatagaccaacccctatggattcaactttcatgtctgccccagtgagcacctgtggaaggccagtacccatggaccctggcactaggcttaacacaggtacagctccaccaaggaggactcagtttccaccctaccccagttccaggctgtccctcaaaaatgcagactcaaggtctgctccagtgccaggccagcccacataaacccaggttgtaaactcaccctggtggacccaggctccaggctcacaactgcagacccatgtgtcaggtctattcccactggactgtaatgcaaggccaaacctgtggaaacagacagcaaggttatctgcctggagacctctgcagtcaaactgcccatagtctcttcaactgttggctcacacaggaattctagacaagctgactggtgaaggactttcccagcagaagccagcctttacaggctacaagagatgataacttcttcaaatgcaaagacacaaaagcaagtttataagaatcatgaaggatcagacaaacatgataccaccaaaggaaataaataaatcaacagtaattgactctaaagaaatggagatatatgaactgtctgacaaggaattcaaaataattgtcttcaagaattcatgggaatacataatgcagataaacaactttaaaaattaggaaaacaatgcatgaacaaaattagaagttcaataaaaatatataagccataaaaaggaatcaaacagaaattcaagagaggaacacagtgacctgaaaaattccataaagagagctgcaaagcagactcaaccaagcaggagaaagaatcagcaagcttgaagacagatcgcttgaaacttgtctcacttggagggaaaaaaaggaaaaataaagttaaaagatcctttggtatttctggaacaccatcctgtgtgtcaatgtatgtattatgggctacccagaaggaacagagaaagaaagagaagctaaaagtatgtttaaagaaatgataataaagaaaagagtccccaaatgtaggaaggaatataaacatccagacccatgaagcccaaagatctacaaaagttaggacataaggatgtcttcaccaaaacacagtagaatcaaattgccaaaattaaggataaagagagaagtttgaaagcactaaggaaaaaatgacttatcacatacaaaggaataaaactattagcagatttgtcagcagaaaccttgcaagccaggagagggtgagataatatattcaaagtgctgaaagaaaaagaaagagaactatcaacacaaaatactcagaaaaactgttcagaaataaaaaagagataaaactttcccagacaaacataatctgagtgagttcatcaccactggacctgccttaaagggaatactaaaggaaattcttcatgcttgaaacaaaagtgagctgaaatgaaaggacactaactaacaacatgaaaacatatgaaagcataaactcctcggtaaggatagactattctaatactatagtagcctggaaataaacccaatatctattaactcatctttgacaaaggtgtcaagaacacacagtaggaggaagaagagtctcttcaatacatggtgttagaaaaactgaatattcacaaacggaagaatgaaattggactcttatctcacaccatatacaaaaagcaaatgaaagtggattgacaacttaaatgcaatacctgaaactataaggttagtagaagaaaacagggaaaataaaatcttgattttggtctggacaatgatattttaatctgataccaaaagcagaggtcacaaaagcaaaaataaatgagcagtattgcatcaaacgaaaagcttcttcacagcaaaggaaacaatcaacaaagtgaaaaggcaatctatggaatgagagaaaatatttgcaagccatgtatatgattaggagttaatatccaaaatataaaagaagcacatacaactcaatagcgaaaaaattaaaaaatggacgaagaatgagaataatcatttctcaaaagaaaatatattaacttccaaccagtatttgaaaagatactcaatatcacttattattatagtaatgcaaatcaaaatcacaatgaaatatcacctcacgcatgtaggatagctatatcagaaaaaagataaatgttagtgaagaagtggtggaaagaaaacccttgtgcacagttggtgagaacataagttgatacagccattgggaacacagtatagagatcccccccaaaattaaaaagcttctgatccagcaatctcacttctggttgtgtatccaaagaaaatgaaatcagtatcttgaaaagatacctgtattccatgtttattggagtattattcacaatacaaggatgtagtaacaatctaattgcctgttggtaacttaatggattagaaaagtgattttatatacacataaatattattcagccttaaaagaaaagaaattcttccatttgcaaaaacatggataaatctgcaggacattatgctaaacaaaataagccaggcacaaaaagacaaatattgcatgtcctcacttttatgtaaaagctaaaataataaaactcatagaaacagtgaatagtatggtggttgtgaggggctagagcagggagaaatggaaatgctggtcaaggtgcataaagttgcacttatgtaaaatctgttgtagagctaaggtacagcaaagtgactatagttattactacagttttgtatacattacagtagatttaagaaggtagagcttaagtttctcaccataccaataaaagtaattaactatgtaaggtgatgagcatattaattatgttgattatggtgattactacccaatgtatacatatataaatcatcaatatgatttataaaaatttcttgaatataaaattgagtataaaaatttcttgtcaaatatacctcaataaagtaggaggagggaaagaaaaatagcatttcaagtcctttaaaatggctgccattaatttcatgccctcagtgctctagatctcaagcaatcaataacatttttccaaaaaaggtttcatattaggtgaaaaaatagcagctctttctgtagcatgagtcgacagggaaactacatggggtgcccactctggaattatgccaccttgccatttacatggcattcagctttcttagaagcctgggttcagataggaaaaagggactctcacaggcttaagttttaaatacacagaattcaattccccattcaggatgggtgtttttcaaacatgtctccccagaatatctgcttctaagacaaagtctttccatcaaaggagataattaattcctgggagagaaagcaatagctaaaagacaaggtctctgaatctttgtagaaacctctttaaatacacatgcagtacaaggtaaaaatgttttttgttgttgttgttcacatctccaaagcaagattcatcaagaattgagtgactcatttacatgtatttcctccacactttcttcatcttaccctgaggggaccagagccatgtaacatcatttttttgtgaaaatgttcagaggctttaggctagaagaaaatatttagacttacaaagagactttcctaacaactgttgatttgatattgaatcacctgaataaactcttttgaagtgtgaaatatctttcacattgaaacttacttatcccaagaaaagataatctcaaataggattgtgtctgagcacccctaaacatcattaagatcatcaaagacaactaaggtaagtttttcaatagtgctgaagcttgtcaaagattgttactttctatatatagtaatcagtatttttcaacactttccaatagagtaatagagtcttgcattctcactccaattattcaaaaggtagttggtaaatatcattaacctaatttgacagttgaaatatttgaggcttatagagattaagcaatttgtagaaccaatctctctgatattgggtaccatgctttcgccatgagacacctccttagtgaatgagacaagttatgaggactaaagcaaaatttaaatacacttcacacacacaaaagacagaaatatgaatattaaatgctatgaataatataaagccctgtaaaaggaaaattggagacctttctttgtgagcttaatgcgtgggcaaatatttctctgtattatattgatcacactgtcaatttatcctgtctcctaggcttatacagccataaaaacaaatgaaagtcctctgtatgtccctaacagtagggtagatatattcatatatgttctcccaattaattctcataacagtatgtgaggtgaatattattatcattttatggatgataagattaagatggaaggtgccaagaaatataccccaggtaaaagaagttataggtggaaaaacgaggattctgatctagtctttctgattctcaaactaacacacttaactattgtgataatggtttttaacactttgcagaagattctggctagggtcccgtgctttggaaggggattaagaaggaatggatagtgctgagggaggggctaagcaaaaacagcccttcagtgaatgtaataccacatttttcttaatatttaggagtttcaatatatcattatgtgtgtgtgtctgtctgctgatgaagttacttcatataaacttgtctctgaagtagtattaaagtaattataaaaattatggccatatcaaagggaaattaaaagttcaacattgtttattataacaatataaggcatgagttaagacttcggagggaaaaaattaacaagcataatctgaaacttaatattgggtccagccttgattatctgctcgatcttgggaggaaacttaatttctatgtgtttctatttcctaatgtgtaaaataagtgtaaaaagacaatagtaactaatacataggttttcagtgaggattcaataagcaaatgtctgtaaaaacacttgaaaaatgctgtgttcagtaaatattagttaatattaacactataactattaatattagtcactgagattgtgtcctcatctgtaaaattgataaaatgagatcatgtgtgcaaagcacattctacaatgtcatgctcatagcaattattcagaggtgtatattattagctattataaagttaataggacttagacaatagattatgaattcttttatagtagctcttatattctttctttacattttcaccacaaattcactgttagtcttatgtcaactactctaaatagtctgctaactaagttccattatctggcttccagctccttactggatctcagcccacgtcacaaaaaacacacaaagaccttcactagagaaatatcccaagaatcccccttcttcagattcctctttatcatttcactcatattgtgcataacatttcatatttcattattttctaaaaaaagagagagagagacagagagcaaattttgagttttgcattcatgtgctttacatctatattctataatcttttcaggcttagttgccactatgtgtgcaatcattcaacttttagttgtttcggatgattaagtgttcacagatggtctcctgcatgtgtgctacaaaagtttctcatgtcaaaactcttagcacagttttcaccagggaggaaatttcagtaaacctccaaaacccaaaacttttttcctgtctcagaaaaaatcctcaaatcacaacccagtagaatccaagaatttattatattacaaattacaatggagaagtttaacaaatttaaagatgtattaataaaaattgttttcttttcaggtaatgcaattagccaccatttgaaatacatggcgaatagaaacaacgtgacagagtttattctattggggcttacagagaatccaaaaatgcagaaaatcatatttgttgtgttttgtcatctacatcaccaccatgataggaaatgtgctcattgtggtcaccatcactgccagcccatcattgaggtcccccatgtaatttttcctggcctatctgtcctttattgatgcctgctattcctctgtcaatgtctctaagctgatcacagattcactctatgaaaacaagactatcttactcaatggatgtatgactcaagtctttggagaacattttttcagaggtgttgaggtcatcctacttactgtaatggcctatgactgctatgtggtcatctgcaagcccttgcgctataccaccatcatgaagcagcatgtttgtagcctgctagtgggagtgtcacgggtgggaggctttcttcatgcaaccatacagatcctcttcatcttccaattacctttctgtagttctaatgtcatagatcactttacgtgtgatctcaaccctttgctcaatcttgcctgcactaatacccacactctaggactcttcgttgctgccaacagtgggttcatatgcctgttaaactttctcttgctcctggtctcctatgtggtcatactgtactccttaaggacccacagcttagaggcaaggcacaaaggcctctccacctgtgtctcccacaacacagttgtcatcttattctttataccctgcatatttgtgtacatgagacctccagctactttacccattgataaagcagttgctgtattctacactatgataactcctatgttaaaccccttaatctacaccttgaggaatgctcagatgaaaaatgccattaggaaattgtgtagtaggaaagctatttcaagtgtcaaataaatgtgactggagcccaacatgattcagctgaggcaagggtcaaaaggacattttgggtaatgtcagcaaggaatacttattggataaataaaataattaaccactgtgatccatagatgatgccttgaggggagtcaaaatgggttcaagaaaaaggagaaaacctaaccgtgtatcattctcacaaactgggaaaattctaccaatttggggcttagtttcactagcttcatccatatatatgaaactcataggccttccttctaataaatgtaaaataagtaataaaataaatatatctatattaagtaataatgtccataacaaactgagggaggcattattcttatccccatttaccaaagaggaaactgagagaaggggacagtgtcaaaatagaagtataaaatagacagtaatcagaatctcactgatttcccaaaccatgtgcttaactaccatgataccctgccagaaagatcagatcattataacagctatcatttattgagacaaggactatgctggacacattgtatatgttagttcattaaaaatataactttttcattaataattctttcacgtttatatatcaaaattaatggcctttgttttctgaaatattatgctgtctaactacttcagggctgtaaaaagcaaagaactatttagcatctgatgggtaaacaatgaagtttataccatgattccaaatgtccttgtaggcttcagaaccattttgtattactcatgttaccctttttatactgataatcaaccagaaagagtgatggttcaaataaagaagatgttttgatatcaaggagaaatttctatttattaaatatacagttatactccataaagtacttgcccgatagataacaatagttcctgcaaggtaccatgtctggtataccataaacagaatcaatgaataaaaggattaatgaaaatgaataaattcaataaaatataaagcaaaagttgtagtggaggctaggaaagtattttctatcttcagactaagaattctggttggacctcatagggaaaccacgttttttcactcttattgaaacaatgagaaagaaattgaaactgcattctcagcatatgaacatgtagtttatcttgatatttttcctactcccagtaaaattttattatcttatgtatatgggctgtttatatttttctagcaatcagtttgctttttggtaacattttcatattaaaagctgttttgtttgttgtttttgagacatagtctctctctgttgcgaggctggagtacagtggcacgatcttggctcactgcaacctccgcctccaaggttcaaatgattcccctgtctcagcctcccaagtagctaggactacaggcacctgccactatgcctggctagtagagatgggatttcaccatgttggccaggatggtctcgatctcctgaccttgtgatctgcccacctcagcctcccaaagtgctggattgtcggtgtgagccaccacacccagtctaaaagctgtttttcaaattatatagctacacacaaagcaatttcaggataactgtattccacttattccttgcattcttttttccttaatcaacaaatactttttatccctaggaatgtatcaggcacattgatagttcctggggcttagtggtgaataaagagaaaccagggtcctcttttcacaaaagttaggatactctgagacacttcaagaagagaacagagaattacaacataatactataaatagtaagatcacggaattacagagtgctgtgaaagcatgttagaaggacacacaacaaagacctaggagatctaaagaggatgcctagatgaaaagacatcaaaaacagaagctgaccaggcacagtggctcatgcctgtaatcgcagcagtttgggaggccaaggagggtggattacttgaggtcaggagttcaagatcagcctggccaacatggtgaaaccgtgtctctactaaaaatacaaaaattggctgggcgtggtggcacatgtctgtaatcccaactacttgggaggctgaggaagaagaatcacttcaacccaggaggcagaggttgcagtgagccaagatcttgccactgcactgcagcctggctgatggagcaagactctgtctcgaaaaagaaaaagaaaaagaaaaagaaaaaacagaagccaaaggcagaaaaggggtcagcagaataagtaggcataaggttgagctaagaggtgcatctatgagagggaataagtaacaaaggccagaagatgagaaagagtcagcaggaaacccaaacaatttgctatgactgtaattatcaatttatctattcattcatcaattatttattgaacccccgttgtgtgccagtgtaggacactgaggttgtaaaagggaaaatacaagatatgaagctggaaaataggatcttggtaagatcaaaaagggtctcataattgtgttaaaaataaatactaagtacaatggagaaaatagtgaaagtacttttaaactagcaagaaacttagttggatttgttttgggaatgataactctagctacagtatggaaaatggattgaagggtcaagcctcccaagagaagaacagctaggaggtaattataatgatttaggtgtgaataaatgggagtctgaacttcggtgactcccaagagatgctgaattttagggacactgttgcatccagctcaaatgccctttgcctggtaagtgaattcatgccccacctgctgtgtctgggctgctaacagctcagagccccacccttccctggacaattgcaccacagaaaataggaggtgcaacacccagaagattatgcccaccgtcaggacccagcagtggccaatgactaacagacatgaaagtttaaaaggttgctgtataatacaatgtatcctccagagcttcaacggctccagactcaattgaggcagacttcaattgagaccacatctgaagccagactccagttgagatcatgtcctttcttccctctaccatagttagcttcccttaaccccttctccttataagtcacttttgtaaaaattctcaatttcagatatgcatctaagaaacccaaactaacgcagagtaatagagacagtttaagatacattaatgaattttgaggaaaataacttgatataggatgaagattagagagaaaacagtcggggatgaaactatgtttctgcttcagaaggaggatactgagaagatggaacagagaaaagataagcctgctttgccagctgaagaggcctccccacctctagtagaacctttccttcactcttagtggaagaaacctcttcacccctactgaaagtttaaccttgcgttgcctgaggaaattatatgtccttccctgaagcagtttcccagcaaaacaatgttgatttccctcaagacccatcttcatcatccctctttgcttctagacctataactagactcaagtttaaactcaactgtgaaaggttaagctgtggtgttgcagatggcatctgaactcactcccagaagacgataaacgttaacttcagaacaaatcaagaaaacttgatttgaatgcaaataaagcaatgttattccctaaaaagtcttgagtttatcacacagtttcagtcaggttagctgaagttgtattagtaagggagtggggaaagagaaaacaaatgtaagattattctatttatctctaagtgctcatggaacgcatgccacaatagaaaatacactgggccacagtacaagatgcagtacatttcaaaggactaaaccatacagaatacatatctaataatagtaggcttcaactaaaaatttataacaaaaatataactaaacattccccaattatttacaaatcaagaaacacaattctaaattattcatatattaaagaagtgccaatgaaaaatttttaatgaattttaactgaaaggcagtaaaaacaaaaaaatactagatggcagctaaagaattgctcagagagaaatatatagctttaaatgcaattattataaaataaaaaagattaaaggaaatgaactaagctttcatctccagaagctagaaatagtagagcaaaataaatgcataaaacatggtatgatatgaatagtaagtagaagacagaaatacttgagataaaattaatttaaaaatagagaaaatacataaagataagggttggttttgtgtaaaaattaataaaactaatttccttagcaaaattggttttaaaatataaggaaaaaaaacaaattatgagaatcagcaatgaaaaggctatgctgtagattctacagatcttaacaagataataaaaagacattacaaatgaattttgctaatgtccttgccagttaaaaagaaatggacctctgctttgaaaaacacagttttctactttttgtcattcaaaaatgcctgtaaaaacaatatttgattgaataaagaaaatgtatgcatcctccatacgcaaagagtcttacaagttaattagaaatcattcagctacaaaatgagcaaaggacaagaacaatttccaaaagaagaatgaatggtcattcttgaaaaactttcaacttcattagtatgaaaaaactttcaacttcattagtaaccagagaaatgcaaatttaaaatatttatactaagcaacttttaatttttattgacaaataataattgtacatatttatggggtaaatagtgacattttgatacacataatgtatagtactaattcagggtaattagcatatccattatctcagacatttatcatttctttggaaaaatgcaactttctaaacacacacacacacacacacacacacacacacaagcaaaacctgaataacatacatgtgctaaatccgctcttgaaaaatttcccctgacttctcccaaaaatatcagattacatcccatgtagctttatcagtgaattatacatatcacttttaaaaaatactaccaattttatctcaacattttaagggattagagaaaatgaaaaagggcattataagaaaaaatatcagataaatatctctcattaacacagacacaaaaattctaaacccaatatttagcaaataaaatacagccatatataaaaataataatgtatcatgagcaagtaagttttgtcccaggaatgaaatgttgatttcacattcaaaatcaattcatggccacatgcagtggttcacactgtaatcccagcactttgggaggctgaggtgggcagatcgcttgatctcaggagttcaagaccagctggggcaaaatactgagaccaccatctataccaaaaaaaaaaaaaaaatttaattagccaggtgtggtggcatgtaccatagttccagctacttggtaggctgaggtgggaggatagcttgagcccaggaagttaaggctgcagtgattggtgattgtgtcactgccctccagtctgggcaactgagtgagaccctgtctcaaaaaaaaaatcaattcatgtaattcactgcatgaacaaaattaagtagaaaaaaatatgatcaattcagtaaatagagaaaaaacttgataagatttaacatacattcatgatttttaaaaagtttaagaaaactaggaatagaacttcctcagtaggataaagcctattaacaaacaccctacagccaacattgtacttaatgaggaaatactaaaaactttctctgggagtcaggaacaatgcaaaactttccattataattacatctattccacattgtgctggagaatctaaccagtgcaataaggcaaagaaaagaaataagtggcatttataaaaatgactaggaaaaattttaaactgtcattatttgcatacaataattttgtgtgtgtagcaaatcaaaatttataaactattaaaactaatacatttatgagatgctacattgtattaaaaatttacaattaaaaatatgcaactacaagatgactgactagattcagctggggtacacctcttccacagaaaggaaccaatatcaagtagatattcacactttaaacagatcgtgtgagaaagagcactggaattcaacaaagagacaacaggagacactgagggtgaaggaaggagatatggggctacctgtttggggttgctaggagccaagagctgccccagacccaaagaaggggtaagtgacggaaccccagagctccatatttctgctgcagaattccataatcctagctgtaggagagtccctcaaccccataggcctctggactggcatagagagctgcctggacatcatgcacaggtgcttctcaaacttacatggagtctcacaagcttctaagcactggacagctgcagcatggtgccattctaggagcccattccccagggatctctttcctgccctgaggctgccactgccactgctggctgctgggccaggtactgagaggggaggccaggggctctcacatgcctcaaggagaggttccactgcttctgctgtgggactgaggtcatttggaccacatgccccatgtctgccagtctctcccaaagctgtctgcctagccattcctatggagagaggaccacccttccaagaggcaggcccacagtgcagccactgttgccctacgtgagtgttcctccagtggccagggaccagctttccctccctaacacagccagcacttgagtccaggaaccccaagggcaaggctgctggcctgatcctatcactgcacaattcaagcatgtcatccaggagcatggagatgagatttgtgatctgatctgatctgatctggagccccccacagccagaagtgagagaagagtgtggtgtgggttcatactgttgtacaggaactgggtacccctcccttcatagtaccagaccaggtagggtgtggcctgagagccaaagtttctgccccagacaaggagtttcatggcctggggaggcttttccatctgaacacagacagcttaggatgtgcctagaggttctggccagctgttggtggcctaatgctgtagggaaacccatggggttggaggtttgggggtggagcaggtcccactgccacttccagctgctgattcatggccacccttcccctctagcatgaaggtgctttgatgcagcagaagtggctctgccccttcctggagggttgctccagtagcctgaaacctgaccccaaacccccagcagaatcagcacttgcaccagctttggagatcctggttcaggacttcccagacccagccgtgcctggctttgccccatccaaccactgcagcagcagagcacaggacagggagccctgggagttccatggccccaccccttacatgagacacccagagcttctgtaatgaacaaaatccaaggaaaaatcccactgctccctctctcttggaaatgccacctactggcttagaagtcaacctgcacagcttatttaactgcccacacaactgcccagtgctcagctggcttgtatctgcaagtgccacctactgacctgtaggtaaaactaaacaacccaatacaatccctgctgacagaagtgcacaatgctggggaataaaataagagacttccccctgctcatctttgcaggaggcagtgatccttctcacatgcccaatccactgccactacaatgtacaaagaatagtatttgagaaaaccattacactaaggctatcatcaaaaaattcatagatttggccccctgaaagtacccagaagcaaagtcaaaggaccctacacaatatatcttatagtcacaccctcaagaggggaataaatttctatccaaacaaaagtaaatccaaaaaggaaacagcataagaattctgggatcatagaaaaaaagagtgttgcaacacacccaaaagatcacactacctctctagcaatggatactgctccccacatccaaggctgctccagcttctgccacagctcaaagggatcctggcacagctcaggttgccactctagagggcacaagccataagctttggcagcttccatgtggtattaagtctgctggtacacagagtgcaagagtgaaggtggcttggcagcctccatctacatttcagaaaatgtatgagaaagcctagatgcccaggcagaagcctgctgcaggggtggagcccttatagagaacctctaatgaggccccacacggagtccctactagagctctgcctagtggagctgtagaaaggcaactgctacagtccagaatccagaatggttgagcttgcaacctaagcatggaaaagtcacagggcagagcagcccaaggctttgggagtccactccttacaacagtgtgccctggatgtgggacatagagtcaaaggagagtatttgggagatttaaagcttaatgactgccttgctgggctttgaaattgcatggggcctatagcccctttcttttggctgatttctcccttttataaagggaatgtttacccaaagcctgtactactattgtttcttggaagtacataacccattttgattttacaggcttgtagatggaagaaactaatctccaggtgagactatggacttggacttggtacttttgagttaatgctggaatgaattaagactttggggggctattgggaaggaatgattgtgttttgcagtgtgacaaaaacatgagattggggaggatgggggtggaatgatagagttttgatatttgtctccacccaaatcttacgttgaaatgtcacccccaatgttggaggtggggcctaatgaaaggtgtttgggtcatggaggtggatccctcatgacttcgtggtgtcctcgtgatagtgagtgagttatcttgagatcaggttattttaaagtctgtgacatcttccccacactttgctcctgctctggctgtgtgacatgcctgctcccacttcaccttccaccatgagtaaaagcttcctgaggcctctccagaagtcaagaagatgccaatgccatgcttgttcagcctgaacaactgtgagccaattagacctcttttgtttctaaattacccagtcctgggtattcctttatagcaatgtaagaatggtctaacatattcaccatcataaaaacacacaaaagtataaaatttacaggtcttataaagcagttacacaactgaaactacaaagccattaggtaacaattaccattatgacagggaaaaaactcacatatcaatatcaactatgaatggaaatgattaaatgctccacttaaaggatatagactggtggaagggattaaaaaaaaaatccagaccgggcccagtggctcatgcctgtaatcccagcactttgggagaccaaggcacgtggatcatctgacatcaggagtttgagaccagcctgtccaatatggtgaaaccctgtttccactaaatatacaaaaattagctgagtgtggtggcacacatctgtaataccagctacttggaggctgaggtaggagaattgcttgaacccaggagacagagattgcagtgagcagagatcatgccacatcactccagcctgggagatggagctagattccatctcaaaaaaaaaaaattcaaccagatgctgcttattacaaacccacaaaattgttgaagacaatttgcaggctcaaggtaaatgtgtgggaaaatatattccatgcaaataaaaacccaaagcaagcaagagtagccatatttatatcaaacataacagacttttaaatcaacaacagtaaaaaaaaagacaaagaaggttattatctaatgacaatgtataaattcaacaagttataacaatcacaaatacataaacacccaacatgagagcacccagaaacataaaacaaatactactagacctaagaaaaggtgtacagtggaataggaacagctccagtctgcagctcccagtgagactgacgcagaaggcaggtgatttctacatttccaactgaggtacctggttcatctcattgggactgattggacagggtgtgcagcccacagagggtgtgccaaagcggggcaggctgttgcctcacccaggaagtgaaatggatcagggaatttccctttccaagccaagagaagctgtgagagactgtaccaggaggaacagtacactcctgccaagatactgtgcttttcccatcgtcttggcaaccagcagaccagaagattccctccagtgcctagcttggtgggtgccaagcccatagagcccagcaagctaagatccattggcttgaaaatctcactgctagtgcagcagtatgagattgacctgggatgcttgagcttggtggggggaggggcatctgccattgctgagtcttgagtaggcagttttatgcttcagtgtaaacaaagatgccaggaaattcaaactgggcggaacccaccacagttcagcaaggcggactgcctctctagattccacctctgtgggcagggcatcactgaacaaaaggcagcagcctcagtcagggacttatagataaagcccctatctccctgggacagaacatctgggggaagggacagcaggggcacagcttcagcagacttaaacatctctgcatgacagctctgaagagagcaaagttctcccagctcagccttcgagctctcataatgaacagactgcctcctctagtgggtccctgacccccatgtagcctgacttggagacatctcccagtaggggccaatagacacctcatacaggagaactctggctggcatctggctggtgaccctctgggacaaagcttccagaggaaagatcaggcagcaatagttgctgttctgcagcctccgctggtgatacccaggaaaacagggtccagagtggacctccagcaaactccaacagacctgtagctgagggtcctggctgttagaaggaaaactgacaaacagaaaggaataccatcaacatcaacagaaaggacatccacaccaaaaccccatccataggtcacctacatcaaagaccaaaagtagataaaactacaaagatggggagaaatcagtgcagaaaagctgaaaattcaaaaaaccagaatgcctcttctcctccaaaggaacacaactcctcataaacaagggaacaaaactggatggagtttgaatgagtttgacaaattgacagaagtaggctccagaaggtgagtaatatcatactcctccaagctaaagaagcatgttctaacccaatacaaggaagctaagaaccttgaaaaaacgttagaggaattgctaactagaataaccaatgtcaagaggagcttaaatgacctgatagagctgaaaaacacagcaagagaactgtgtgaagatacacaagtttcaatacctgaatcaatcaagtggaaaaaaggatatcagtaattgaagatcaacttaatgaaataaagcaagaagacaagattagagaaaaaagagtgaaaagaaatgaacaaagcctccaagaaatatgagactatgtgaaaataccaaatctatgcttggttggtgtacctgaaagtgacagggagaatagaaccaagtttgaaaacactcttcaggatattatccaggagaacttccccaaccttgcaaggcaggccaacattcaaattcaggaaatacagagaacaccacaaagatatgcctcaagaagagcaacccaaagacacataattctcagattcaccaaggttgaaatgaaggaaaaagtgttaagggcagccagagggaaaagtcaggttacccacaatgaaaaggcaatcagactaacagtgaatctctctgcagaaaccctacaagccagaagagggtgggggccaatattcaacattcttaaagaaaagaattttcaacacagaatttcatatccagttaagctaagcttcataagtgaaggaaaaacaaaatccattacagacaagcaaatgctgagagattttgtcaccatgaggcctgccttacaagagctcctgaaggaagcactaaacatagaaaggaacaaccagtaccagccactgcaaaaacatgccaaattgtaaagaccattgacactatgaaaaaagtgcatcaactaatggtcaaaacaaccaactagcatcataaggacaggatcaaattcacacataacaatattaaccataaatgtaaatgggctaaataccccaattaaaagacacagactggcaaatgggataaagagtcaagacccatcagggtgctgtgttcagagacccaggtcatgtgcaaagacacacataggctcaaaataaagggatggaggaagatctaccaaccaaatggaaagccaaaaaatgcaggggttgcaatcctagtctctgacaaaatagactttaaaccaacaaagatcaaaagagacaaagaaggccattacataatggtaaagggatcaatgcaacaagaagggctaactatcctaaatatatatgcacccaatacaggagcacccaaattcataaagcaagttcttagagacctatagggagacgtagactcccacacaataataatgggagactttaacaccccactgtcaatattagacagatgactgaaacagaaaattaacatggacatccagaatttgaactcagctctggaccaagcagactagtaaatatctacagaactctccaccccaaatcaacagaatatacattcttctcagcaccacatcgcactcattctaaaattgaccacataattggaagtaaaacactcctcagcaaatgtaaaagaacagaaatcacaacaaactgtctctcaggccacagtgcaatcaaactagaactcaggattaagaaactcactcaaaaccgctcaactacaaggaaactgaaaaacctgctcctgaatgactaccaggtaaatagtgaaatgaaggcaaaaataaagatgttctttgaaaccaatgagaacaaagactcaacataccagaatctctgggaccatttaaagcagtgtgtagggggaaatttatagcacaaaatgcccacaagtgaaagcaggaaacatctaaaatcgacaccctgccatcacaattaaaagaactagaggagcaagagcaaacacattcaaaagctagcagaaggcaagaaataactaagatcagagcagaactgaaggagacagagacacagaaaaacccttcaaaaaatcgatgaatccaggatttggttttttgaagagatcaacaaaattgatagagtgctaccaagactaataaagaaaagagagaagaatcaaaccgacgcaataaaatttgataaagaggatattaccaccgagcccacagaaatacaaactaccatcagagaataatacaaacacctctaagcaaataaaactagaaattctagaagaaatggataaattcctggacacatacaccctccaaagactaaaccaagaagaagttgagtctctgaatagaccaataacaggctctgaaattgaggcaatcatttatagcctaccaatcaaaaaaagtccaggaccagatggattcacagccgaattctatcagatgtacaaagaggagttgatatcattccttctgaaactattccaatcaatagaaaaagagggaatcctccctaactcattttatgaggccagcatcatcctgataccaaaacctgacagagacacaacaaaaaaagaaaattttaggccaatgtccctgatgaacattgacatgaaaatcctcaataaaatactggcaaactgaatccagtagcacatcaaaaagcttatccaccacaatcaagtcgcctttatccctgtgatgcaagtctggttcagcatatacaaatcaataaatgtaatccatcacataaacagaaccaatgacaaaaaccacatgattatctcaatagatgcagaaaaggccttcaacaaaattcaacagcccttcatgctaaaaactctcaataaactatgtattcatggaatgtatctcaaaataataagagctatttatgacaaacccacagccaatatcatactgaatgggcaaatactggaagcattccttttgaaaactggcataagacaagtatgccctctctcaccactcctattcagcatactattagaagttctggccagggcaatcaggcaaaagaaatgaagggtattcaaatagaaaaagaggaagtcaaattgtctctgtttgcagataacatgattgtatatttagaaaaccccatcgtctcagtgcaaaatctccttaagttgataagcaacttcaccaaagtctcaggatacaaaaccaatgtgcaaaaatcacaagcattcctatacaccaataaaagccaaacagagagccaaatcatgagtgaactcccattcacaattgcttcaaagagaataaaatacctaggaatccaacttaaaaggaatgtgaaggacctcttcaaggagaactacaaacaactgctcaaggacataaaagaggacacaaacaaatgaaagaatattccatgctcatggataggaagaatcaatatcgtgaaaatggccatactgcccaaaatcatttatagattcaatgctatccccgtcaagctaccactgactttcttcacagatttgcaaaaaaatcctttaaatttcatatggaacaaaaaaaaagagcccatacaacccaagacaattctaagcaaaaagaataaagctagaggcatcacgctacctgacctcaaactatactagaaggctagagtaaccaaaacagcacggtactggtaccaaaacagatatatagaccaatggaacaaaatagaggcctcagaaataatgctacacatctacaaccatctgatctttgacaaacctgacaaaaacaagaaatgaggaaaggattccccatttaataaatgttgctgggaaaactggatagccatatgcagaaagctgaaactggatcccttccttacaccttatacaaaaattaattcaagatgaattgaagacttaaacataagacctaaaaccatagaaaccctagaagaaaacataggcaatacaattcaggacataggggtgggcaaagacttcatgagtaaaacaccaaaagcattggcaactaaagccaaaatcgacaaatgggatctaattaaactaaagagcttctgcacagcaaaagaaactatcagtagagtgaacaggcaacctgcagaatgggagaaaatttttgtaatctatccatctgacaaagggttaatatcagaatctacaaagtacttaaacaaatttacaagtaaaaacaaacaaccctatcaaaaaatggggaaaggttatgaacagacactgctcaaaagaagacatgtatgcagccagaaaacttatgaaaaaattctgatcatcactggtcattagagaaatgcaaatcaaaaccacaatgagataccatctcacgccagttagaatggtgatcattgaaaagtcaggaaacaacagatgctggagataatgtggcaaaataggaatgcttttacactgttggtgggaatgtaaattagttcaaccattgtggaagacagtgtggtgattcctcaaggatctagaactagaaatagcatttgacccagcaatcccagtgctggatatatacctaaaagattataaatcttttgactataaagacacatgcacatgtatgtttattgcagcactgttcacaatagcaaagtcttggaaccaacccaaatgcccatcaatggtagactcgataaagaaaatgtggtggcacatatacttcatggaatactatgcagccataaaaaaggatgagttaatgtcctttgcaggggtacggatgaaactggaaaccatcattctcagcaaagtaacacaagaagagaaaaccaaacactgcattgttgggagcaggccccccaaaatctggccataaactggccccagaactggccataaacaaaatctctgcagtgctgtaaaatgttcataatggccctaacgcccaagctggaaggttgtgggtttacaggaatgaaggaaaggaactcctggcccgcctagggcagaaaaccacttaaaggcattcttaagccacaaacaatagcatgagtgatctgtgccttaaggacatgctcctgctgcagttaactagcccaacctattcctttaatttggcccacccctttgtgtcccataagggatacttttagttaatttaatatctacagaaacatgctcatgactggttttctgttaataaatacgtaggtaaatctctgttcaggctctcagctctgaaggctctgagacccctgatttcccacttcacacctctatatttcagtgtgtgtctttaatttctctagcagcagtgggttactgtctccctgactaagctggtctcggcactgcatgttctccctcataagtgggagttgaatgatgagaacacatggacaccaggagaggaacatcacacacagggacctgtcagggggttgggggctggtgcaaggatatcattaggagaaatacctaatataaatgaagagttgatgggtgcagcaaaccaacttggctcatgtatacctatgtaacaaacctgcacattgtgcacatgaactccaaaacttaaagtataataaaaacaaaaattcaaaaccatagaagaaaaaagacattgtaaagttcctcaatttacttgagaagccattattatgttgaaataataaaatttaaaaagaaaacttctcggccaggcacagtggctcatgcctgtaatcccagcactttcagaggccaagacaggcagatcatgagaccatcctgtctaacacagagaaaccccatctctacataaaaaaattagccgggtatactgtgtccatgtgttctcattgttcaattcccaactatgagtgagaacatgcagtgtttggttttttgtccttgtgatagtttgccgagaatgatggtttccagcttcatccatgaccttacaaagtacaagaactcatcattttttatggctgcctagtattccatggtgtatatgtgccacattttcttaatccagtctatcattgttggacattcggcttggttccaagtctttgctattgtgaatagtgtcacaataaacatacttgtgcatgtgtctttatagcagcatgatttataaccttttgggtacatacccagtaatgggatggctgagtcaaatggtatttctagttctagatccctgaagaatcaccacactgactcccacaatggttgaactagtttacagtcccaccaacagtgtaaaagtgttcctatttctccacatcctctccagcacctgttgttccctgactttttaatgatcaccattctaactggtgtgagatggtatctcattgtggttttgatttgcatttctctgatggccagtgatgatgagcattttttcatgtgttttttggctgcataaatgtcttcttttgagtagtgtctgttcatatcctttgcccactttttgatggggttgtttgtttttttttcttgtaaatttgttgtatttcattgtagattctggatattagccctttgtcagatgaatagattgcaaaaatgttctcccattctgtaggttgcctgttcactctgatggtagtttcttttgctctgcagaagctctttagtttaattagctcccatttgtcaattttggcttttgttgccattgcttttggtgttttagacatgaagtccttgcccatgcctatgtcctgaatggtactgcctaggttttcttctagggtttttatggttttagatctaagtctttattctatcttgaattaattttgtataaggtgtaaggaagggatccagtttcagctttctacatatggcaagccagttttcccagcaccatttattaaatagggaatcatttccccatttcctgtttttgtcaggtttgtctaagatcagatagttgtagatatgtggcattatttctgagggctctgttcagttccattggtctatatctctgttttgtaacaaatctgcacgtggtgcacatgtaccctaaaacttaaagtataataaatatatatatatatatatacatttaaggcagaggctggaggatcacttgagcccacatgttcaaggctgaagtgagtcatgatcatgccactgcactccagcctgggccacagagcaataccctgtctcaaaaacagacagacaactttttgcagctcaagtttcaatccttaacaaaaaaatttgaaatggtacaaatcttttctttaccatatacactttatttcaaaatagggctgcagataaattaagaatcattttccaaagaagttatttgagtctcctcttttcaaaaagaaaaagaattaacaaataagttaaactgaaaaaataaaatttaggaaataaagaacaacctataacacatattcaaataaaatgacaaatcagctaatttagaacactatgggtgtgttattcctggaaaccatcaagggaaggacagaaaaccatctgccacaggagatgaataagttgactacttaatctctggacatcacttcccactgcacggtctataaattgctccaactaagctcctcccactttctttataaaactgtgttgtgaatttttggcaaaaagattttagacaaattgtgaaagtcaaattctgtttgacataccaagccacaaactttgaaactgtttcccagcttttaccattgtagattataaaatatcaaaagcagcaagactgtcatatgggcaacattatgtttaagctgtgttaaagttaagcaaaattttgcattgaggaaacatatgtaaaagtgagttataaactgtaaatatatgtgttacatgttcaaatttctttaatatagaaatgtaaaatggatgctttagtttttttcaactatggataaaaatagtatttaatgctaattttttcaggaaataaagtttaaaatggcaaaataaatttttaagggaaggaaatgcagtgtatgatataccaaaaaagcaaataaatttattctttttccagcagtgctattcagaaaatgttatagaagttaaaacctgtttttgaaaataagcaaggcatagaaataaaaaagagaaatgtgaaaaaaataaaagttagccaggcatggtggcaggggcctgtagtctcagctactcaggaggctgaggcaggagaatggcgtgaacatggaaggcggaccttgcagtgagccgagatcatgccactgcactccagcctgggcaacagagccagactccatttctaaaaggaaaaaaagaaaacttgtcaatcccaattatgaataaagttaaaaaaatagaaaaaaataaaaaaattgtaaaaagcatagattttaaaaaaagtgtacagccatgtaataatagtgggggacttcaatacccccactgatggcactagacaaatcattgaggcagaaaatgaacaaagaaactgtgagctaaaactggactctaaaccacatgaacctaatggacacttacagagcattctacccaacacatgaaaaatacacattcttctcatctgtgcatagaatattctcaaaaataaaccatatactagtccacaaggcaagtctcaataaatttttttaaattgaaaccataacaagaattttcttggatcagagtggaataaaactagaaataaatattaaaaggagctctcaaaacaatacaaatccatggaaattaaacaacctgctcctgaacaaacttcatatcaatgatgaagcaaggcagaaattttaaagaaattggaaacaaatggaaatagaaacacagcatctcaaaacttctgatatacagcaaaaacagtgctaagagggaacttaatagggttcaatacctacatcaaaaaagtagaaatatctcaagttgtcaaccgaatgttgtacctcaaggaactagaaaatcaagaacaaacaatagccaaagttaaaagaaaaaaaactacacagatcagaacttggtaaaattgggaccaaaaaaatatgtaaaggatcaatgaaattaaaagttggctctttgaagagatgaacaaaattggtagactgctagatagagtaaccaagaaaaagagagaatattcgtgtaagtataataagaaatgataaaggtgacattacaattgataccacagaaatacaaaagattatcataaactactatgagcatctctacacaaataaactaaaaaacctggaggaaaagtatatatatttctgaaaacatataacatcccaagattgaaccaggaagaaatagaaatgctaaactgaccagtaatgactaattaaacttaaatagtaattttaaaacctcccccagcttgtcaagaaaagccaaagaccagatagatttataattgaattctaccagatgtaaaaaaagtactggtaccaactctatggaagctgttttaaaaaaataaagaagagaatcctcccttactcattctatgaagccaggatcactctgatgccaaagccattcaagggcacatacatacacaaatactacagaccaatatccctgatcaatatctatgcaaaaatctcaataaaataccagcaaaacaaatccaacagcacatcaaaaataaaatgccctacaatcaagtgagttttactacagagatgcaagaatggttaaacatatgcaaatcaataaatgtgattcaccatatcatatgaattaaaaataaaaaccatgtgatgatctcaataaatgcagaaaaggaatttcataaaattcagcatctcttcctgataaaaactctcaaaaaaactaggcatcaaaggaacaaaactcaaaataataaaaattatattcaacaaacccacggccaacagtatactggacaggatactgtttaaagcattcccctttaagaactggaacaagacaaggatgcccactttcaacactcctactcaatacagttagtactagaagtcgtagctagagaactcaggagagacaaataaaacatatccaaattggaaaataagaagttaaattatttctgttgactgataatatgatcaaaaaaccaaaaaaaaaaaaaaaacaaacaccaaagactcctccaaaagactcctagatttcacaaatgacttcattaatgtttcaggatacaaaatcaacatgcaaaaatcagtagcatttttatataccaataacaatcatgctgagaactaaatcaagaagtgaatcctatttacagtagttgcaagaagaataaaatacatacaaataaacttaaccacagaggtgaaagatctccacaaggagaactacaagacactgataacacaatcatcgatgacacaaacaaaaatcctatgctcatggattgtaagaataaatactcttaagatggcaagaaatctatagattcaatgcagtttctatcaaattaccaatgccatttttcaaagaattgggaaaagtcctagaattcatatggaactaaaaatgaccctgaatagccaaggcaatcctaagcaaaaataacaaagctggaggcattacattacctgactttaaattatactccaaggctataataactaaaacagcatgacactgatacaaaaatagacacatagatcaatggaacagaatagagaacccagaaataaagccacatacctataactgactgattctcaacaaaggtgacaaaaatatgcactgagggaaggacaacctattcaataaatgataaattggatagccatatgcagaggaataaatgtggacccatatctctcactatgtaagaaaattaacacaagatggataaaaagacttaaatgtaagtctgaaactataaagatcatagaagaaaacctaagaaaagctcttctggacattggcctgggcaaaaaatttatgaccaagtcctcaaaatcaaacacaacaaaaatatataaaggggacttaataaaattaaatagcttctgcacagcaaaataattaacagaataaacaatttaaaaaatgggagaaaatatttgcagattaagcatctgacaaaaggatagtatgaagaatctacaaggaactcaaataagaaaactaataataaccccatttaaaagtgggaaaaggacataaacaggcacttttccaaaaaacagacatacaagcagaaacaaacatgaaaaagtgcttaacaccactgatcatcagagaaatataaattaaagccacaatgaaattccatcttacaccagtcagactggctattattaaaaagtcaaaaacaacaggaaatatacaatactgctaggaataaaattaataaaacctgcaagaaaaacagagggagatttatcaaagaactaaaaatagtactgccctttgatccagcaatcccactactgggtatccgcccaaagaaaaagacatcattctatcaaaatgacacctgcactatgttctttgcagcactattcacaatagtaaggacacggaatcaaccatcaacagatgatggataaagaaaatgtgagatatatagatagatatcacaaatgtgagatatatatacacatacatacacacacacacacacacacacacaccatggaatggtactcagccataaaaaatgtaatcttgtattttgcagcaatatggatggaactggtggacatgattctaagttacataacccaggaacagaaagccaaatgctacatgttctcactttttttaagtaactaaacagcaaatttttatttagtttttttgttattattatacttcaagttctaggatgcaactgcagaatgtgcaggttttttacacaggtatacacatgtcatggtcatttgctgcacccatcaacccatcatctacattaggtatttctcctaatgctgttcctcccctaacccccaatcccccgacaggccccagtgtgtgatgttcccctctctctgtccatgtgttatcattgttcaactcccacttatgagtgtagatgttctcactttcagtgagagctaaacaatggcatacatggacatacagagtgaaaaagtagacattggaaactccaaaaggtgggagggtgggagaatgttgagagctgaaaaattacttactggatacaatgttcactatgcaggaaatgagtacacttaaagcccagacctcaccactacacaatatatccatggaacaaacctgcccttgtacccttaaaatctatttaaaaaaaaaaaacagaacagttctttgagaaatctccaaaccactctccaaagtagctgagctaatttacattcccgccaacattatgtaagtgttcccatttctctgcagcttcaacagtattatttttactttttatctaaaagttcaaaatattttttaaatgtacaactacaaaaaattggtaaaagcaattttaaaatatctaaataaacagagagatattccaggtccatggatttggagacaggatattgctattattttattctctccacattaataattagagattctgaaaaaactgaaaaacaaagcataacaagttataaaacaagatcaattcacttatcaggcgattatttggggaaaaacaagaatagcatgtgaaaataaatgtcactaactatcctaatcttgataaaatggtaaaagcaccgttcccaaatttcaaaatacataaattggactttatcaaaattaaaaatgcttctgaatcaaagtacactatcaaaaaagtgaaaatcaacccaaagaataggagaaatatttgtaaaatcatatatctgataagagtcttgtttccagaatatataaagaactcttacaactcaacaaaaaaaggtaaacaacccaatttgaaaatacgcaaagaatttgaaaaagacattttccgaatacgatatacatataactaataagcatataaaaataggctaaacatcattggtcattgggaaatgtaaatcaacattgcaatgaaataccacttcacacccagtggatggccataattttttaaatggcaattatccagtgttggcaaggatattgaataattggaaatctactacaattactaaaggaaatgtaaaatctatggatctctgaaaaactgtttggttgttcttcaaaaagttgaacatagaatgaccacctgacccagaaattccactcctatatatataccgaaaagaattaaaaacaggtgtttgaacaaacttgtacacaagagtttatagcagcactactcacaattgtgaaaacaacctaaatttctatcagtctgtatgaatggataaccaaattgtggtatgtccacaataaagtactgatgcatgctacaacatggatgaaacttgaaagcatactaagtgaaagaagacactaaaggttgaaaattgcctaattctatgtatataaaatgtccaaaataagcaaattaataggaacaaaaagcggattagtggttaccagggactggggaaaaggggaaatagaaatgactgttcaactattcggaggcaatgaaaatgttctgcaattagatagttgtaattatcgtaaaacattgtgattgtacccaaagccaattgattatacatttttaaatagtcaaaaaatgaattttttcatataatttttatgttaaagaaatcacaacacaaaaggtattttgaaataaatgaaatttaaagcacaacatatctgaatttcagggaagtaataaaagttctaaaaaggaaatttgggtcacaaagtgtatacattaaaaataaataggccgggcacagtggcttacacttgtaatcccagctactagggaggctgaaacaagagagaatcacttgaccctgggaggcagaggttgcagtgagccaagattcgtgccagtgcactctagcctgggtgacacagcaagactccatctcaaaataaataaattaattaattaaaataatgtctgaaaacaattatcaaaggttttgtactacagaaacagaaaataacaacaaattaagcagaaactaagtagaagataggaaataataaagattagaacaagaatcaatgaaatgtaaattttaaaaatagaaaaatcaatgaaacaaatatctgattattttaaaagatcaataaaattgataaacaattagctgaattaatgtgaaggagcaaaagatggaaagaagtaaggggagagagagagaaaaggcaactcatgtcaataatgaaagtgcatatagccttgcagattccacttaatgatgaacactatccctctaagattgggaacaagacaaggatgtccactcatcatttccattcagctatgaaacctaggtctagcaatataccctaggtttcagccattgcaaaaatataagaaaaggaaataaaagacacacagcttgcaaaggaagaaacaaaattataaaaatacgtttatttgcagatgacataattatgtaggtagaaaatttaaagtattctgcaaaaaactaataggcctaatcagtaagtttagcaaagtaacaggatgtaatgtcaatattttaaaaatcaattgtatttctacaatagcaacaaacaattagaaatggaaattagaaacaaaatactatataaaacattatttaaaacatgaaatttgaggagtaaattataacaatcaattcaaaacctgtatatgaaaagtagaacacactggtcagagaaattaaatacataaataaatggagggatataccatattaataaatagaaaacaataattattttaccatatcattctatattttcaatgcaattccaatcataatttttggagatgttgacaagcttatcctgaaatttatatgcaaatgtgcgaacttaaaaggaactagaatagcaaataattatcaaaaagaagaaagattagttcttactctacctaatttcaagatttagtataatgtaccagtatcaatactgtttggtattggcttaaggataaaaatatagctcactaaaatataacagaatgtccaaaaatacatccaaatatataaatttttaaaagaatgccaaggcaactcaatatttttcaacaaattatgctgagtcaattggatacccataagaaaaaaaaaaaaacttcagccattacctcatataatgcacacacacacaaaaatgaccttaaaatgagttagagatccacatgctaaatctataaaatttctacaagaatttgttttgaccttaaggaaatcctgccatttgtgacaatgtggaaaaacctagaggacactatgctaagtgaaataagccagacacagaaagtcaaacgctgtataatctcacttatatgcagaatctaaagagtcatactcatagaaacagagagaatgatggtagaatgacggttgccagggcctggggaatgagggatatgggaatatatttatcaaagagaacaatctttcatctataagatgaacaggttctgaggatctcatgcacagcatgattagtaatgtatgtgttaattttctgtaataactattacacaatgtacgtctcgatcaaatcaacattttatccaccttggatatataaaatctttgtcaattaaatatttttaaatttaaaaattaaaattaattaaatggtcacaattagtttcatgccctcactgctctagacctcaaggaaccattagcaggtttccagaaaaaggcgtaatgttgatttttttaaaaaagaaaattcctgtgacatgaatcaacagagaaactacatcacaggtcctcacacaagttacgctaccttgctactcaaacagaattcagcattcttaacaacacaggctcagatagagaaagaggactcaaaggattagattccaagtgtaaagaatgaaattccttattcaggaattgtttgttttttttttccaaacatgtctctccagaatactgcttctgtggcaaagtttttccatcaaaggagataattaattcctaggagagaaagcagcagctataaaataagatccctgaatctttacagaaacctctttaaatattcatgcagtgcaagacagaagtgtttttcttgttcactcatccacagcaagattaatcatgggcaaagtgatccatttataactgtttcctccacaccttctgcctcttgcactgtggaaccagagccatatgtaatcaattcttcatggtgtttccagtgaattgattttaattcaagtcccaggttttctgtgaaaatttttgagacttaggccagataaaaagatttatagtcataagaacactttctttattgaattataactgatataccaaaaaactacacatttaatgtgtacagttttttaacaactgtgatttaacattgaatcatctgaataggctctttccatgtgttaaatctttcacaccaaaacttactaattccaaaagaagatcagtttgaagaagattgtgtctgaacactcccaaacatcaagattatctaactaagactactaaggtaagttttctaatagtaccgatgcttcttaaagatagttaatttaagtagtcagtaatcattatttttcaacacctcaaacatagtatatagagtctttcatcctcatcccaatgtttcaaaagatagtaaatataattaacctatttgacagttgaaaattttgagtttcttagaaattcagcaatttgtaggacccagctctctgacaccgggtaccatgcttctgccatgataatcagactagccataaagattaaatatataactaacctgcacattgtgcacatgtaccctaaaacttaaagtataataataaaaaataataataataacaataagcacatgaaatattacctaaatagcattatgaaaagtaacagcatttccaaaacaaaaaactagttagtgagaaaagtggcattgttttaaatttttgccagtgtctggtttagtaaaatacagccagattctcaaaacaaaaaaaaaaaagattaaaacaaaattaaaatacatatcgtatacacaaaggacataaatatgaatactaaattgcataaatcatcagctgtttagtccaagcactaacatgaagaccccttcctgggatcaacagctatggacagtatgagtcactgtggcttcttcaagagtaatgttggagattattcttcctgaggttattgcatggtcaatgatgctctgtttattgctctaatgatcacttcttatgatcccttagctgtgtacacacctgtaaaagtaaagaaagtcctatgtgcatccacagcactgtggtaaacattttcttatatgttccctcaatcaattctcataacagcctgtaagatgatattgttattctcactttatagatgaggaaacaaagatgaaaggtggcaagaaacatgccctggcttaaaaaagttgcaggtggaaaaacaatgattctaatcacatatatttttaattctaaatctaatatacttggccactgtagtagttattttcttttctttttctttttttttttttttctgagacggactctcgctctgttgcccaggctggagtgcagtggcctgatctcggctcactgcaagctctgcctcccgagttcatgccattctcctacctcagcctcccaagtagctgggaccacaagtgcccgccaccatgcacagctaattttttgttgctttttttttttttttgagacagagtttcactctgtcgcccaggctggagtgcagtggcatgatcttggctcactgcaatctccgcctcctgggttcacgccattctcctgcctcagcctcccgaatagctgggactacaggcacctgccaccacaccaggctaattttttgtatttttagtagagaccgagtttcaccatgttagccagggttgtctcgatctcctgacctcgttatcctcccgcctcggcctcccaaagtgctggacttataggcgtgagccaccacgcccggccagtagtcattttcaacattttgttcaagagtctgggggcccacgacttggtggggtgggggtgttgaggaaagagctgggactaggggagaagctaagatagatgtaccttcaatgattcaataccacatttttcttaatatttgaactcaaagatgtcactgtgttgtgggtggggaggggggatacggctaatgaaattgctccatacaaattgcctctgaagtagtattaaagtaagtataatcataatggtcatatcaaaaggagattattagttcaacattgtttattataacataacaacatagggcatgagctcagaatttggagagaaaaaattaactagtataatgtgactaatcttgactctgtcctttattaaactgcttgatcttggatgggatcttcaacttccctatgcttctacttcctaatatgtaaaataagtataaaaatgatagtactattttctgggtttattttgtgattgcctgcaaaaaaacatttagaagacactagtgctcagtatgttttagttaatattatcaatattatgagtgttataatgttaatataaataatattacattattgtataatataaatatcattgtgttaacataactattaacattaatcactaatattgctgccttatctgaaaatttgatgaaataatactggtcacctaggatgttataagtgttcactggaatcatgtgtgcaaagcacttactactatggcttttgcaagacaattaattattaaagggcatataatattagttattataaagttaattagatttagacaataagcattatgaattattttagtagctcttatatcctttttttatacttctttctgtctctctctgtcactctctgtcacccaggctggagtgcagtggtgtgatcttggcctcactgtaatttctgcctcctgagttcaagtaattcccctgcctgagcctcccaaatagctgggaatacaggcaagcaccatcacgcctggttaactttttgtattttagtagagatggggtttcaccatgttggccaggatggtctcgatttcctgacctcgtaatccacccgcctaggcctcctaaagtgctgggattacaggtgtgagccaccggcccagccacccagttacttcttatgtcaagtactctaaatattctgcccactggggttcctttctctggctaacacctgctttgcagaacctcagcccacttcatccaagacatacaaagacttgtactagtgggatactccaagattcctactcctcaaattcctcttcatcttcccactcatattgacagtaacctaccaatgttccccatttcctaaagaataaatggcaaattccttagctttacaccatggcctttaaattcattgtcaatctcccttttcaggtttagctgctaccgtgtatccaatctactacttcaaattgagctcttaggcctcccagatgattgagtatacacacatgacatcctgactttgttcacaagagtttctaatgtcgatactcttcacagagtcttcaccaagtaatcttcaagaactgagaaactttattaacatctcaagaaaaaccttataggaatttacagtttaataaaattcaagcatttattattaaaatggagatatgtaataaattcaaagttgtattaataaaaaatttttac
